US010258682B2

(12) United States Patent
Caldwell

(10) Patent No.: US 10,258,682 B2
(45) Date of Patent: Apr. 16, 2019

(54) ATTENUATED CHLAMYDIA VACCINE

(71) Applicant: The United States of America, as Represented by the Secretary, Department of Health & Human Services, Washington, DC (US)

(72) Inventor: Harlan D. Caldwell, Hamilton, MT (US)

(73) Assignee: The United States of America, as represented by the Secretary, Department of Health & Human Services, Washington, DC (US)

( * ) Notice: Subject to any disclaimer, the term of this patent is extended or adjusted under 35 U.S.C. 154(b) by 0 days.

(21) Appl. No.: 14/761,520

(22) PCT Filed: Jan. 16, 2014

(86) PCT No.: PCT/US2014/011799
§ 371 (c)(1),
(2) Date: Jul. 16, 2015

(87) PCT Pub. No.: WO2014/113541
PCT Pub. Date: Jul. 24, 2014

(65) Prior Publication Data
US 2016/0015798 A1    Jan. 21, 2016

Related U.S. Application Data

(60) Provisional application No. 61/753,320, filed on Jan. 16, 2013.

(51) Int. Cl.
| | | |
|---|---|---|
| *C12N 1/36* | (2006.01) | |
| *C12N 15/74* | (2006.01) | |
| *A61K 39/118* | (2006.01) | |
| *A61K 39/00* | (2006.01) | |

(52) U.S. Cl.
CPC .............. *A61K 39/118* (2013.01); *C12N 1/36* (2013.01); *C12N 15/74* (2013.01); *A61K 2039/522* (2013.01); *A61K 2039/53* (2013.01)

(58) Field of Classification Search
None
See application file for complete search history.

(56) References Cited

U.S. PATENT DOCUMENTS 6,248,329 B1 *    6/2001    Chandrashekar .. C07K 14/4354
424/130.1

FOREIGN PATENT DOCUMENTS

| WO | WO-95/28487 A2 | 10/1995 |
| WO | WO-00/34498 A1 | 6/2000 |
| WO | WO-2007/100577 A2 | 9/2007 |

OTHER PUBLICATIONS

Feng et al (Infection and Immunity, 64(1):363-365, 1996).*
The Dictionary of Immunology, Herbert et al eds, Academic Press, 1995; 3 pages.*
L. Song et al: "Chlamydia trachomatis Plasmid-Encoded Pgp4 Is a Transcriptional Regulator of Virulence-Associated Genes", Infection and Immunity, vol. 81, No. 3, Jan. 14, 2013 (Jan. 14, 2013),-Mar. 1, 2013 (Mar. 1, 2013), pp. 636-644.
Pickett M A et al: "The plasmids of Chlamydia trachomatis and Chlamydophila pneumoniae (N16): accurate determination number and the paradoxical effect of plasmid-curing agents", Microbiology, Society for General Microbiology,Reading, GB, vol. 151, No. 3, Mar. 1, 2005 (Mar. 1, 2005), pp. 893-903.
Comanducci M et al: "Diversity of the Chlamydia trachomatis common plasmid in biovars with different pathogenicity", Plasmid, New York,NY,US, vol. 23, No. 2, Mar. 1, 1990 (Mar. 1, 1990), pp. 149-154.
Jennifer R. Carmichael et al: "Differences in infectivity and induction of infertility: a comparative study of Chlamydia trachomatis strains in the murine model", Microbes and Infection, vol. 15, No. 3, Dec. 31, 2012 (Dec. 31, 2012), pp. 219-229.
G. L. Sturdevant et al: "Frameshift Mutations in a Single Novel Virulence Factor Alter the In Vivo Pathogenicity of Chlamydia trachomatis for the Female Murine Genital Tract", Infection and Immunity, vol. 78, No. 9, Jun. 14, 2010 (Jun. 14, 2010),—Sep. 1, 2010 (Sep. 1, 2010), pp. 3660-3668.
Akers Johnny C et al: "Molecular mechanism of tryptophan-dependent transcriptional regulation in Chlamydia trachomatis", Journal of Bacteriology, American Society for Microbiology [Not]Etc., vol. 188, No. 12, Jun. 1, 2006 (Jun. 1, 2006), pp. 4236-4243.
S. Gong et al: "Characterization of Chlamydia trachomatis Plasmid-Encoded Open Reading Frames", Journal of Bacteriology, vol. 195, No. 17, Jun. 21, 2013 (Jun. 21, 2013),—Sep. 1, 2013 (Sep. 1, 2013), pp. 3819-3826.
Lihua Song et al: "Plasmid-mediated transformation tropism of chlamydial biovars", Pathogens and Disease, vol. 70, No. 2, Nov. 11, 2013 (Nov. 11, 2013), pp. 189-193.
L. Kari et al: "A live-attenuated chlamydial vaccine protects against trachoma in nonhuman primates", The Journal of Infectious Diseases, vol. 204, No. 2, Oct. 24, 2011 (Oct. 24, 2011), pp. 268-2223.
Olivares-Zavaleta N et al: "Immunization with the attenuated plasmid-less Chlamydia trachomatis L2(25667R) strain provides partial protection in a murine model of female genitourinary tract infection", Vaccine, Elsevier Ltd, GB, vol. 28, No. 6, Feb. 10, 2010 (Feb. 10, 2010), pp. 1454-1462.
Albrecht, M. et al., Nucleic Acids Res. 38:868-877 (2010).
Caldwell, H. D. et al., J. Clin. Invest.11:1757-69 (2003).
Caldwell, H.D. et al., J Immunol 115:963-968 (1975).
Carlson et. al., Infect. Immun. 76:2273-2283 (2008).
Chattoraj, D.K., Mol. Microbiol. 37:467-476 (2000).
(Continued)

*Primary Examiner* — Patricia Duffy
(74) *Attorney, Agent, or Firm* — Locke Lord LLP; Nicholas J. DiCeglie, Jr.; Andrew W. Smith

(57) ABSTRACT

The invention provides vectors, attenuated pathogens, compositions, methods, and kits for use in preventing or treating infection by an infectious pathogen, especially *Chlamydia trachomatis*. The vectors comprise the plasmid encoded ppg genes from *Chlamydia*, ppg1, ppg2, ppg3, ppg5, ppg6, ppg7 and/or ppg8, but lack ppg4, a regulator of virulence associated genes. The application also provides attenuated pathogens, especially *chlamydia*, which are cured of their plasmid and have additional mutations to improve the attenuation, especially mutations in the CT135 gene or in the tryptophan operon (trp promoter, trpA, or trpB). Uses of said nucleic acids and attenuated pathogens for inducing or modulating an immune response in a subject, especially for prevention or treatment of infections, are proposed.

30 Claims, 196 Drawing Sheets
Specification includes a Sequence Listing.

(56) References Cited

OTHER PUBLICATIONS

Gerdes, K. et al., Mol. Microbiol. 37:455-466 (2000).
Kakutani, R. et al., Glycobiology 22:146-159 (2012).
Kari et. al., J. Exp. Med., 208:2217-2223 (2011).
Matsumoto, A. et al., J Clin Microbiol 36:3013-3019 (1998).
Morrison and Caldwell, Infect. Immun. 70:2741-2751 (2002).
Mycobacteria tuberculosis glucans (Geurtsen, J. et al., J. Immunol. 183:5221-5231 (2009).
O'Connell et. al., J. Immunol. 179:4027-4037 (2007).
Ricci, S. et al., Gene 154:93-98 (1995).
Ricci, S. et al., Mol. Gen. Genet. 237:318-326 (1993).
Schachter, J. et al., Br Med Bull 39:151-154 (1983).
Schachter, Rev. Infect. Dis.7:713-716 (1985).
Seth-Smith, H.M. et al., BMC Genomics 10:239 (2009).
Stibitz, S., Methods Enzymol. 235:458-65 (1994).
Sturdevant, G. et al., Infect. Immun.78:3660-8 (2010).
Tam, J.E. et al., Plasmid 27(3):231-236 (1992).
Thomas, N.S. et al., Microbiology 143:1847-1854 (1997).
Wang et al., PLoS Pathog. 7:e1002258 (2011).

\* cited by examiner

FIG. 1A

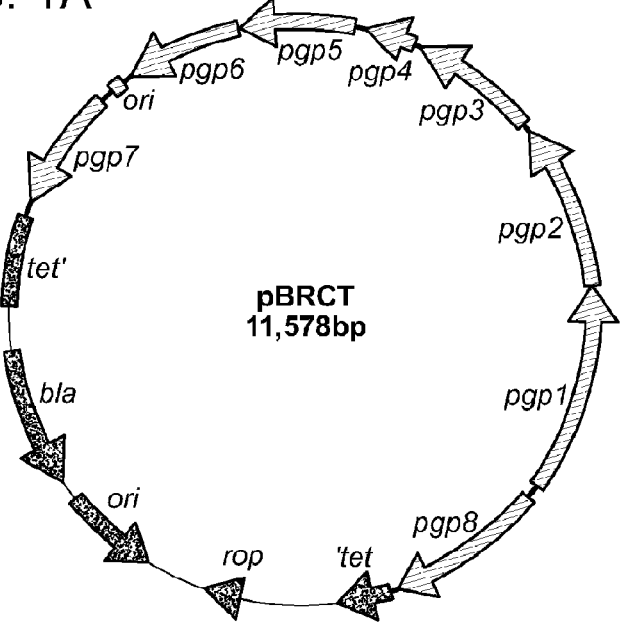

>pBRCT (sequence chlamydial ORFs are in lower letters and E. coli in capital letters)
tcctaggctaggtggagtgtctattatgcagatgtcataaaaaggagcgcagtactcattcagaaataactttaagttgttactaggtcctc
tatgaatatccaattctctaaactgttcggataaaaatgatgcaggaattaggtccacactatctttttttgtttcgcaaatgattgattttaaat
cgtttgatgtgtatactatgtcgtgtaagccttttttggttacttctgacactagcccccaatccagaagataaattggattgcgggtctaggt
cagcaagtaacactttttttccctaaaaattgggccaagttgcatcccacgtttagagaaagtgttgtttttccagttcctcccttaaaagagc
aaaaaaactaaggtgtgcaaatcaactccaacgttagagtaagttatctattcagccttggaaaacatgtcttttctagacaagataagcata
atcaaagccttttttagctttaaactgttatcctctaattttttcaagaacaggagagtctgggaataatcctaaagagttttctatttgttgaagc
agtcctagaattagtgagacacttttatggtagagttctaagggagaatttaagaaagttacttttttccttgtttactcgtattttaggtctaatt
cggggaaatcttttttcacatctttaacaattttaataaaaatcgtccctcactttgcttttatttgcataacaaacccgtaattcgaacttttttc
tctaaatataaaacctataagaaaaatccaataaaaattgtttaagcgtttgtttgaggtattacctccaaaaaagatacattagaagtatttg
ttattcctaaaatatcattgccattagaaagggcattaacccataccacaccgctttctaaaccgcctacacgtaatgaatacgttgtcgga
gtcaatcctgtattaataattctggttcttagactacataaattaggaacgcctgatgagtatccataactaatcgcgtagggcttagaatca
cctctcgtaccaaagctagaacaacgccgccttccattcttgatgcaataatatctgctgagactaagaacatgctcccagagcttttgg
gtgtgactgtgaattttcctatttcagttcctcctaataaagtttcaatgttcctgggagtgaataacccgttgcattgaatttattagtgattg
gaaagttgttaaaagctttcaacaaacctagagaagggtctgttgtgattttgtctaaaatatcttggactgtactatcaacaatagtatcag
caattccaccaagaatttgatctcccaactttttctagaataagctggtaagcttttccgcatccaaaccaattgtaatagaagcattggttg
atggattattggagactgttaaagatattccatcagaagctgtcatttttggctgcgacaggtgttgatgttgtcccaaggattatttgctggt
ccttgagcggctctgtcatttgcccaactttgatattatcagcaaagacgcagttttgagtgttatacaaataaaaaccagaatttcccatttt
aaaactctttttttatttttgagctttaaataaattaggttttttagttttcaagtttgctattaattaatagattcttgttctaattgttccatttgttctttaga
tttcttagttatttcttcaaaacgctctttatttagatatagaatttcttttttagagagtttagaagaatccagaaattcaatgcgttttcttctaga
taaccaaccaagctgaatggcgatttctatacatttatcgatagctaactcgatttttttccagttccttgtacaaatgtaccgattcatccta
aaatatatgcaagactttaacgttaacgttaagaacaagttttctggccaagaattatccttagttaattttcgtctcttttttcgcagctgctgt
aatcacccagtcgataaatgtgtaagcatactttgatgcatttgggaagcgcatttttatttcttggtatacatttgcaggcttgattacaaagt
aggattctatttgatctaccaagataggacatggctctacaacgaaccctttatgtttccgtgtagatggtgaattaaaaggtgttaagtcta
tatctatatttcttcgtcagttaaaccttcccatccttcgtaaatcctaatgatcggagaaagagtttggtaacggtctactatttgtgttccatt
agtccatcgagttctagttgccactattaaaaacggttgatgtcctaaatggtataaggcttctaaagcagtttcagcttcttttccactaaac
tcatacttatttctggatgttttataccgcttaactccataagcctctaagaattcagttttttgtaaaacggattcttggtatccatccttcaaatt
gaaaactatttgattctctggataaaacaacccctttttgtgttccccttgtaattcgttgcagtcagcaatctttggatagctgctaatgcatg
gtaatgagatgaaagaaaatcaagacctataacttctaccatcccatttttgagccaatttgggagatatcttaatagattgaccaggtcttct
tccaaacttctgattttcaaggtggataggacttttgatgaagtggcagttactataatttaccatactttttttaatagcggagaatttactaatt

FIG. 1A (cont.)

tttggatcgaaatgtaataccgaagagaaaaccgatccatgtctattttccccaacagttatctcacaattagaagacgattccttcctattg
ataaacaaaatcacatctgcgtcttgctctatttgaccgctgtctcgcaaatctgaaagcatgggaactttatttgctctatcctcaactttct
agatagttgggataaacaaactataggaatgtttagctctgaggctaaacctcttaaggttctagatatatctgctatttcattttgacgatttt
ctccaaccgatgagttgatcaactgcaagtaatcgataaatattacgtctactcgatcttcttttctcagcaaccggatctgattcgcgatta
aattaagcttatactgactatcactgcagatataaaaatgtgattctctaactgtttctccagcttcttctactcggaataattcttcttagaga
gatccctctttgtaatttttcaccagatattcctgttaaattagcaataatccgctcaacaatttgacctgcgctcatttctagagataggaaa
ccaactctacgctgttgagtaaccgcaagatttatcgccatgtctatagctaaagcagttttccctatagatggcctagctgctataatcac
gaaattaccttagctaagataactcctttatcatcaatatccttgtatcctgttgggaaggcatcaaagaaagaattttgattctcagagaac
gttgctcgtctttttttatacgagccagcactccaatttctgactgtgagaatatatcataaatagaccggcctctagcgctgcgaatagaa
aaagtctttgctatagcactgtcaagcctcccttatacgctcaagcaatagaaacggagatctacgcaatggattttcattgtactcatta
aacgagcggaaaatgaaattactcaaattttcttcagcgctacacacgctcaaatcatcgaggaaaaccgtatgagaaacggatctaag
cttgtcatttgataaagcatcatgcaacattaacccgagatacgatttgtccatatctttgatacgacgccgcaaaagctcttcccaagccg
agtctacagttataggtaatccattgtcttttaagtatttaaatactatgaatatgttttatgatgagaacacttaaactcataattagcaagct
gcctcagaatatactcagtagagtcttcaaatatcagagctttacctaacaacgcatactcgatatcttgcatgcgattttctatttcggaac
gagttttcatgtttatataaaaaaataccgagcgtgctatcctgttaacaacctgattatttcactaatcaggacattttacggataggttatat
cacgagggatttcatgggtaaagggatttatctttgcagcaagaaatgtcgttagaatatagcgaaaagtcttatcaggaagttttaaaaa
ttcgccaagaatcctattggaaacgcatgaaaagcttctccttattcgaagttattatgcattggaccgcatcactcaacaaacatacttgta
gatcatatcgaggatctttttgtctttagaaaagattggtctattgtccttggatatgaatctgcaagagttttcccttttaaatcataatctaatt
ctagatgcgattaaaaaagtttcctctgccaagacttcttggaccgaaggtactaaacaagttcgagcagcaagctatatttccttaacaa
gattcctaaacaggatgactcaaggaatagtcgctatagcgcaaccttctaaacaagaaaatagtcgaacattttttaaaaccagggaaa
tagtaaaaacagatgcgatgaacagtttgcaaacagcgtccttcctaaaagagctaaaaaaaatcaatgcccgggattggttgatcgcc
cagacaatgctccaaggaggtaaacgctcctctgaagtcttaagcttggagattagtcagatttgtttccaacaagctaccatttctttctcc
cagcttaagaaccgtcagacagaaaagaggattattataacttatcctcagaagtttatgcactttctacaagagtacatcggtcaacgaa
gaggttttgtcttcgtaactcgctccggaaaaatggtggggttaaggcaaatcgcccgcacgttctctcaagcaggactacaagctgca
atccctttaagataaccccgcacgtgcttcgagcaaccgctgtgacggagtacaaacgcctagggtgctcagactccgacataatga
aggtcacaggacacgcaaccgcaaagatgatatttgcgtacgataaatcttctcgagaagacaacgcttcaaagaagatggctctaata
tagcctaaaagtgtttttctggcaacagaatatgaatataattttaattatatcacaatCGGCCGACGCGCTGGGCTACG
TCTTGCTGGCGTTCGCGACGCGAGGCTGGATGGCCTTCCCCATTATGATTCTTCT
CGCTTCCGGCGGCATCGGGATGCCCGCGTTGCAGGCCATGCTGTCCAGGCAGGTA
GATGACGACCATCAGGGACAGCTTCAAGGATCGCTCGCGGCTCTTACCAGCCTA
ACTTCGATCACTGGACCGCTGATCGTCACGGCGATTTATGCCGCCTCGGCGAGCA
CATGGAACGGGTTGGCATGGATTGTAGGCGCCGCCCTATACCTTGTCTGCCTCCC
CGCGTTGCGTCGCGGTGCATGGAGCCGGGCCACCTCGACCTGAATGGAAGCCGG
CGGCACCTCGCTAACGGATTCACCACTCCAAGAATTGGAGCCAATCAATTCTTGC
GGAGAACTGTGAATGCGCAAACCAACCCTTGGCAGAACATATCCATCGCGTCCG
CCATCTCCAGCAGCCGCACGCGGCGCATCTCGGGCAGCGTTGGGTCCTGGCCACG
GGTGCGCATGATCGTGCTCCTGTCGTTGAGGACCCGGCTAGGCTGGCGGGGTTGC
CTTACTGGTTAGCAGAATGAATCACCGATACGCGAGCGAACGTGAAGCGACTGC
TGCTGCAAAACGTCTGCGACCTGAGCAACAACATGAATGGTCTTCGGTTTCCGTG
TTTCGTAAAGTCTGGAAACGCGGAAGTCAGCGCCCTGCACCATTATGTTCCGGAT
CTGCATCGCAGGATGCTGCTGGCTACCCTGTGGAACACCTACATCTGTATTAACG
AAGCGCTGGCATTGACCCTGAGTGATTTTCTCTGGTCCCGCCGCATCCATACCG
CCAGTTGTTTACCCTCACAACGTTCCAGTAACCGGGCATGTTCATCATCAGTAAC
CCGTATCGTGAGCATCCTCTCTCGTTTCATCGGTATCATTACCCCCATGAACAGAA
ATCCCCCTTACACGGAGGCATCAGTGACCAAACAGGAAAAAACCGCCCTTAAC
ATGGCCCGCTTTATCAGAAGCCAGACATTAACGCTTCTGGAGAAACTCAACGAG
CTGGACGCGGATGAACAGGCAGACATCTGTGAATCGCTTCACGACCACGCTGAT
GAGCTTTACCGCAGCTGCCTCGCGCGTTTCGGTGATGACGGTGAAAACCTCTGAC
ACATGCAGCTCCCGGAGACGGTCACAGCTTGTCTGTAAGCGGATGCCGGGAGCA
GACAAGCCCGTCAGGGCGCGTCAGCGGGTGTTGGCGGGTGTCGGGGCGCAGCCA

FIG. 1A (cont.)

TGACCCAGTCACGTAGCGATAGCGGAGTGTATACTGGCTTAACTATGCGGCATCA
GAGCAGATTGTACTGAGAGTGCACCATATGCGGTGTGAAATACCGCACAGATGC
GTAAGGAGAAAATACCGCATCAGGCGCTCTTCCGCTTCCTCGCTCACTGACTCGC
TGCGCTCGGTCGTTCGGCTGCGGCGAGCGGTATCAGCTCACTCAAAGGCGGTAAT
ACGGTTATCCACAGAATCAGGGGATAACGCAGGAAAGAACATGTGAGCAAAAG
GCCAGCAAAAGGCCAGGAACCGTAAAAAGGCCGCGTTGCTGGCGTTTTTCCATA
GGCTCCGCCCCCTGACGAGCATCACAAAAATCGACGCTCAAGTCAGAGGTGGC
GAAACCCGACAGGACTATAAAGATACCAGGCGTTTCCCCCTGGAAGCTCCCTCGT
GCGCTCTCCTGTTCCGACCCTGCCGCTTACCGGATACCTGTCCGCCTTTCTCCCTT
CGGGAAGCGTGGCGCTTTCTCATAGCTCACGCTGTAGGTATCTCAGTTCGGTGTA
GGTCGTTCGCTCCAAGCTGGGCTGTGTGCACGAACCCCCGTTCAGCCCGACCGC
TGCGCCTTATCCGGTAACTATCGTCTTGAGTCCAACCCGGTAAGACACGACTTAT
CGCCACTGGCAGCAGCCACTGGTAACAGGATTAGCAGAGCGAGGTATGTAGGCG
GTGCTACAGAGTTCTTGAAGTGGTGGCCTAACTACGGCTACACTAGAAGGACAG
TATTTGGTATCTGCGCTCTGCTGAAGCCAGTTACCTTCGGAAAAAGAGTTGGTAG
CTCTTGATCCGGCAAACAAACCACCGCTGGTAGCGGTGGTTTTTTTGTTTGCAAG
CAGCAGATTACGCGCAGAAAAAAAGGATCTCAAGAAGATCCTTTGATCTTTTCTA
CGGGGTCTGACGCTCAGTGGAACGAAAACTCACGTTAAGGGATTTTGGTCATGA
GATTATCAAAAAGGATCTTCACCTAGATCCTTTTAAATTAAAAATGAAGTTTTAA
ATCAATCTAAAGTATATATGAGTAAACTTGGTCTGACAGTTACCAATGCTTAATC
AGTGAGGCACCTATCTCAGCGATCTGTCTATTTCGTTCATCCATAGTTGCCTGACT
CCCCGTCGTGTAGATAACTACGATACGGGAGGGCTTACCATCTGGCCCCAGTGCT
GCAATGATACCGCGAGACCCACGCTCACCGGCTCCAGATTTATCAGCAATAAAC
CAGCCAGCCGGAAGGGCCGAGCGCAGAAGTGGTCCTGCAACTTTATCCGCCTCC
ATCCAGTCTATTAATTGTTGCCGGGAAGCTAGAGTAAGTAGTTCGCCAGTTAATA
GTTTGCGCAACGTTGTTGCCATTGCTGCAGGCATCGTGGTGTCACGCTCGTCGTTT
GGTATGGCTTCATTCAGCTCCGGTTCCCAACGATCAAGGCGAGTTACATGATCCC
CCATGTTGTGCAAAAAAGCGGTTAGCTCCTTCGGTCCTCCGATCGTTGTCAGAAG
TAAGTTGGCCGCAGTGTTATCACTCATGGTTATGGCAGCACTGCATAATTCTCTT
ACTGTCATGCCATCCGTAAGATGCTTTTCTGTGACTGGTGAGTACTCAACCAAGT
CATTCTGAGAATAGTGTATGCGGCGACCGAGTTGCTCTTGCCCGGCGTCAACACG
GGATAATACCGCGCCACATAGCAGAACTTTAAAAGTGCTCATCATTGGAAAACG
TTCTTCGGGGCGAAAACTCTCAAGGATCTTACCGCTGTTGAGATCCAGTTCGATG
TAACCCACTCGTGCACCCAACTGATCTTCAGCATCTTTTACTTTCACCAGCGTTTC
TGGGTGAGCAAAAACAGGAAGGCAAAATGCCGCAAAAAAGGGAATAAGGGCGA
CACGGAAATGTTGAATACTCATACTCTTCCTTTTTCAATATTATTGAAGCATTTAT
CAGGGTTATTGTCTCATGAGCGGATACATATTTGAATGTATTTAGAAAAATAAAC
AAATAGGGGTTCCGCGCACATTTCCCCGAAAAGTGCCACCTGACGTCTAAGAAA
CCATTATTATCATGACATTAACCTATAAAAATAGGCGTATCACGAGGCCCTTTCG
TCTTCAAGAATTCTCATGTTTGACAGCTTATCATCGATAAGCTTTAATGCGGTAGT
TTATCACAGTTAAATTGCTAACGCAGTCAGGCACCGTGTATGAAATCTAACAATG
CGCTCATCGTCATCCTCGGCACCGTCACCCTGGATGCTGTAGGCATAGGCTTGGT
TATGCCGGTACTGCCGGGCCTCTTGCGGGATATCGTCCATTCCGACAGCATCGCC
AGTCACTATGGCGTGCTGCTAGCGCTATATGCGTTGATGCAATTTCTATGCGCAC
CCGTTCTCGGAGCACTGTCCGACCGCTTTGGCCGCCGCCCAGTCCTGCTCGCTTC
GCTACTTGGAGCCACTATCGACTACGCGATCATGGCGACCACACCCGTCCTGTGG
ATCCTCTACGCCGGACGCATCGTGGCCGGCATCACCGGCGCCACAGGTGCGGTTG
CTGGCGCCTATATCGCCGACATCACCGATGGGGAAGATCGGGCTCGCCACTTCGG
GCTCATGAGCGCTTGTTTCGGCGTGGGTATGGTGGCAGGCCCCGTGGCCGGGGG
ACTGTTGGGCGCCATCTCCTTGCATGCACCATTCCTTGCGGCGGCGGTGCTCAAC

FIG. 1A (cont.)

GGCCTCAACCTACTACTGGGCTGCTTCCTAATGCAGGAGTCGCATAAGGGAGAG
CGTCGACattggggtgtttgtactagaggacttacctcttccccagaacaataagaacacacactttgtctcgatgaaagacagg
aaatacgcatgatttcctcatcttttaatcctatttgctttaaatgaatcaaagcgcttgcacgaagtactctaggagtaattttttttcatagc
actatagaactctgcaagcctaaaattatgcgcaacctgacttgttgttacaggaatccctattttagaaacaaatactctcccatttctccc
acaagtgtattttttgcaactcctccattaagctgataggaaatgtgattagaattttggtttctttattctgtcttttttttaatgcgaaaggaaatc
tgattggatgcaaaaaatagatcgtctgtgcgcaaagacaaaatttcgtctaacttacggatcccttgtacaatcaatttaccgattaaata
gtctctataattcactatccggagcgcttcaaaaaaaactgtccattcctgcttagaaatcgattctgtttgattttgtctcggatttaaaaaa
tgtagtgtttccaaaatctttcaatggaatagcgggtttaatatatcccttggtcaatctatacaaaaactttgtgaaagatatgtagcatgcc
gctctagcctgtttagaggcctctgaaacgactttccattaaaaacatctagagacttgattttaaacaaagattcgctgtggtcaagaga
aatagcctttatcaaggtttccgataaatccagaatctctaaagaaacaagaaagttaatcccagacgcataattttttctagttagatgaga
taaagtagataaccaaatttccgacgcgtccccaaaagttaagaacaacctacttttatggaaagccatcgagcccattttcttaaccaaa
gctattcaaaatcggagctctaagattttaagaaattttttcaacaaaagtccattatgaccaagtctaccaccaagagttgcaaagtctacc
accaagagttgcaaagtctaccaccaagagttgcaaagtctaccaccaagagttgcaaatctctctcgtaaaatcaaatccctaaatatat
atatataatagatatatatatgagctgacggaggatcagctctttttgcttaaaaagttcaaaaagctgttgtagaagattttcgttataggag
gacaaagaaactccggaacacatgatgcgaagtatctctattaagaaatcagataattggcgattcttctctgaatcagacttatctatcgt
ttctctaacgtcttgtttctagatgaaggaagaaattgatccaacacccttatcgccgatgagttcgacattccacatactttccctatcaca
tcgaccttggttttttaaatcgccttttctagcggccaaaatatatgcggatttataggggatcgattgaaactcttttgtagagtttggttggg
gaggtttataaaaagctcgtaatatgcaagagcattgtaagcagaagacttagttctaaaaactaactctatccaagatgaaaaagttgtt
gaggagaagtgatccttactcaggattttttctagcattatagattttttctcctaaaagaagtacgtgttgcttctgtatggattttatctgacca
gtaagcagttttaccgctaggatgtcttcttgataaaattcttcatccgaatagttttgggactctgataaaaataattgatccaaactctgact
ttcctcagaattcaaagttgctgagaatagttcaatggaaggaagcgtcttcttaaaatctaaagaagcggcagtttgattttttttaaaaaa
gacattcgcttcttttttttagtttgttcacgttgtcctctgagagtaatctcgttcatattcgatatgcaaaatatttgctatttcatgcgttaacttc
agaatatcttctgcggccctagaatttggatagacattagctacagaatcttctttaagaagagaacggctgagagaaatatctcgacga
attttttgttgaaaaaagcttgtttttgtaaatagactcgataatgtctatatacatttggttagtcgagttacgatcatcccaaaaagacaaagc
tattccaagaatgtgttcttcttcaggttttccgaccgaacttaagaattcacgtatctttgtaaccctagaatagaaaaaggttctggagtt
aaacaagcaattaatttgtctcctgcaacaaaagcttctttcgttaaccc

FIG. 1B

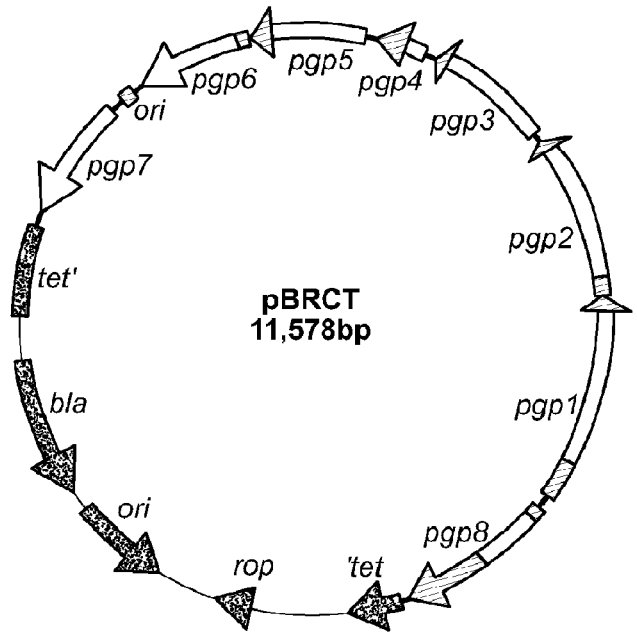

FIG. 1B (cont.)

Deletions for each chlamydial plasmid ORF – capital letters are the deleted regions for each ORF >pgp1
atgaaaactcgttccgaaatagaaaatcgcatgcaagatatcgagtatgcgttgttaggtaaagctctgatatttgaagactctactgagt
atattctgaggcagcttgctaattatgagtttaagtgttctcatcataaaaacatattcatagtatttaaatacttaaaagacaatggattacct
ataactgtagactcggcttgggaagagcttttgcggcgtcgtatcaaagatatggACAAATCGTATCTCGGGTTAA
TGTTGCATGATGCTTTATCAAATGACAAGCTTAGATCCGTTTCTCATACGGTTTTC
CTCGATGATTTGAGCGTGTGTAGCGCTGAAGAAAATTTGAGTAATTTCATTTTCC
GCTCGTTTAATGAGTACAATGAAAATCCATTGCGTAGATCTCCGTTTCTATTGCTT
GAGCGTATAAAGGGAAGGCTTGACAGTGCTATAGCAAAGACTTTTTCTATTCGCA
GCGCTAGAGGCCGGTCTATTTATGATATATTCTCACAGTCAGAAATTGGAGTGCT
GGCTCGTATAAAAAAAAGACGAGCAACGTTCTCTGAGAATCAAAATTCTTTCTTT
GATGCCTTCCCAACAGGATACAAGGATATTGATGATAAAGGAGTTATCTTAGCTA
AAGGTAATTTCGTGATTATAGCAGCTAGGCCATCTATAGGGAAAACTGCTTTAGC
TATAGACATGGCGATAAATCTTGCGGTTACTCAACAGCGTAGAGTTGGTTTCCTA
TCTCTAGAAATGAGCGCAGGTCAAATTGTTGAGCGGATTATTGCTAATTTAACAG
GAATATCTGGTGAAAAATTACAAAGAGGGGATCTCTCTAAAGAAGAATTATTCC
GAGTAGAAGAAGCTGGAGAAACAGTTAGAGAATCACATTTTTATATCTGCAGTG
ATAGTCAGTATAAGCTTAATTTAATCGCGAATCAGATCCGGTTGCTGAGAAAAGA
AGATCGAGTAGACGTAATATTTATCGATTACTTGCAGTTGATCAACTCATCGGTTG
GAGAAAATCGTCAAAATGAAATAGCAGATATATCTAGAACCTTAAGAGGTTTA
GCCTCAGAGCTAAACATTCCTATAGTTTGTTTATCCCAACTATCTAGAAAAGTTG
AGGATAGAGCAAATAAAGTTCCCATGCTTTCAGATTTGCGAGACAGCGGTCAAA
TAGAGCAAGACGCAGATGTGATTTTGTTTATCAATAGGAAGGAATCGTCTTCTAA
TTGTGAGATAACTGTtgggaaaaatagacatggatcggttttctcttcggtattacatttcgatccaaaaattagtaaattctc
cgctattaaaaaagtatggtaa >pgp2
atggtaaattatagtaactgccacttcatcaaaagtcctatccaccttgaaaatcagaagtttggaagaagacctggtcaatctattaagat
atctcccaaattggctcaaaatggGATGGTAGAAGTTATAGGTCTTGATTTTCTTTCATCTCATT
ACCATGCATTAGCAGCTATCCAAAGATTGCTGACTGCAACGAATTACAAGGGGA
ACACAAAAGGGGTTGTTTTATCCAGAGAATCAAATAGTTTTCAATTTGAAGGATG
GATACCAAGAATCCGTTTTACAAAAACTGAATTCTTAGAGGCTTATGGAGTTAAG
CGGTATAAAACATCCAGAAATAAGTATGAGTTTAGTGGAAAAGAAGCTGAAACT
GCTTTAGAAGCCTTATACCATTTAGGACATCAACCGTTTTAATAGTGGCAACTA
GAACTCGATGGACTAATGGAACACAAATAGTAGACCGTTACCAAACTCTTTCTCC
GATCATTAGGATTTACGAAGGATGGGAAGGTTAACTGACGAAGAAAATATAGA
TATAGACTTAACACCTTTTAATTCACCATCTACACGGAAACATAAAGGGTTCGTT
GTAGAGCCATGTCCTATCTTGGTAGATCAAATAGAATCCTACTTTGTAATCAAGC
CTGCAAATGTATACCAAGAAATAAAAATGCGCTTCCCAAATGCATCAAAGTATG
CTTACACATTTATCGACTGGGTGATTACAGCAGCTGCGAAAAAGAGACGAAAAT
TAACTAAGGATAATTCTTGGCCAGAAAACTTGTTCTTAAACGTTAACGTTAAAAG
TCTTGCATATATTTTAAGGATGAATCGGTACATTTGTACAAGGAACTGGAAAAAA
ATCGAGTTAGCTATCGATAAATGTATAGAAATCGCCATTCAGCTTGGTTGGTTAT
CTAGAAGAAAACGCATTGAATTTCTGGATTCTTCTAAACTCTCTAAAAAAGAAAT
TCTATATCTAAATAAAGAGCGTTTTGAAGAAataactaagaaatctaaagaacaaatggaacaattagaa
caagaatctattaattaa

FIG. 1B (cont.)

>pgp3
ATGGGAAATTCTGGTTTTTATTTGTATAACACTCAAAACTGCGTCTTTGCTGATAA
TATCAAAGTTGGGCAAATGACAGAGCCGCTCAAGGACCAGCAAATAATCCTTGG
GACAACATCAACACCTGTCGCAGCCAAAATGACAGCTTCTGATGGAATATCTTTA
ACAGTCTCCAATAATCCATCAACCAATGCTTCTATTACAATTGGTTTGGATGCGG
AAAAAGCTTACCAGCTTATTCTAGAAAAGTTGGGAGATCAAATTCTTGGTGGAAT
TGCTGATACTATTGTTGATAGTACAGTCCAAGATATTTTAGACAAAATCACAACA
GACCCTTCTCTAGGTTTGTTGAAAGCTTTTAACAACTTTCCAATCACTAATAAAAT
TCAATGCAACGGGTTATTCACTCCCAGGAACATTGAAACTTTATTAGGAGGAACT
GAAATAGGAAAATTCACAGTCACACCCAAAAGCTCTGGGAGCATGTTCTTAGTCT
CAGCAGATATTATTGCATCAAGAATGGAAGGCGGCGTTGTTCTAGCTTTGGTACG
AGAAGGTGATTCTAAGCCCTACGCGATTAGTTATGGATACTCATCAGGCGTTCCT
AATTTATGTAGTCTAAGAACCAGAATTATTAATACAGGATTGACTCCGACAACGT
ATTCATTACGTGTAGGCGGTTTAGAAAGCGGTGTGGTATGGGTTAATGCCCTTTC
TAATGGCAATGATATTTTAGGaataacaaatacttctaatgtatcttttttggaggtaatacctcaaacaaacgcttaa >pgp4
ATGCAAAATAAAAGCAAAGTGAGGGACGATTTTATTAAAATTGTTAAAGATGTG
AAAAAAGATTTCCCCGAATTAGACCTAAAAATACGAGTAAACAAGGAAAAAGTA
ACTTTCTTAAATTCTCCCTTAGAACTCTACCATAAAAGTGTCTCActaattctaggactgcttc
aacaaatagaaaactctttaggattattcccagactctcctgttcttgaaaaattagaggataacagtttaaagctaaaaaaggctttgatta
tgcttatcttgtctagaaaagacatgttttccaaggctgaatag >pgp5
GTGGGATGCAACTTGGCCCAATTTTTAGGGAAAAAAGTGTTACTTGCTGACCTAG
ACCCGCAATCCAATTTATCTTCTGGATTGGGGGCTAGTGTCAGAAGTAACCAAAA
AGGCTTACACGACATAGTATACACATCAAACGATTTAAAATCAATCATTTGCGAA
ACAAAAAAAGATAGTGTGGACCTAATTCCTGCATCATTTTTATCCGAACAGTTTA
GAGAATTGGATATTCATAGAGGACCTAGTAACAACTTAAAGTTATTTCTGAATGA
GTACTGCGCTCCTTTTTATGACATCTGCATAATAGACACTCCACCTAGCCTAGGA
GGGTTAACGAAAGAAGCTTTTGTTGCAGGAGACAAATTAATTGCTTGTTTAACTC
CAGAACCTTTTTCTATTCTAGGGTTACAAAAGATACGTGAATTCTTAAGTTCGGT
CGGAAAACCTGAAGAAGAACACATTCTTGGAATAGCTTTGTCTTTTTGGGATGAT
CGTAACTCGACTAACCAAATGTATATAGACATTATCGAGTCTATTTACAAAAACA
AGCTTTTTTCAACAAAAATTCGTCGAGATATTTCTCTCAGCCGTTCTCTTCTTAAA
GAAGATttctgtagctaatgtctatccaaattctagggccgcagaagatattctgaagttaacgcatgaaatagcaaatattttgcatat
cgaatatgaacgagattactctcagaggacaacgtga

FIG. 1B (cont.)

>pgp6
gtgaacaaactaaaaaaagaagcgaatgtcttttttaaaaaaaaatcaaactgccgcttctttagattttaagaagacgcttccttccattgaa
ctattctcagcAACTTTGAATTCTGAGGAAAGTCAGAGTTTGGATCAATTATTTTTATCA
GAGTCCCAAAACTATTCGGATGAAGAATTTTATCAAGAAGACATCCTAGCGGTA
AAACTGCTTACTGGTCAGATAAAATCCATACAGAAGCAACACGTACTTCTTTTAG
GAGAAAAAATCTATAATGCTAGAAAAATCCTGAGTAAGGATCACTTCTCCTCAA
CAACTTTTTCATCTTGGATAGAGTTAGTTTTTAGAACTAAGTCTTCTGCTTACAAT
GCTCTTGCATATTACGAGCTTTTTATAAACCTCCCCAACCAAACTCTACAAAAAG
AGTTTCAATCGATCCCCTATAAATCCGCATATATTTTGGCCGCTAGAAAAGGCGA
TTTAAAAACCAAGGTCGATGTGATAGGGAAAGTATGTGGAATGTCGAACTCATC
GGCGATAAGGGTGTTGGATCAATTTCTTCCTTCATCTAGAAACAAAGACGTTAGA
GAAACGATAGATAAGTCTGATTCAGAGAAGAATCGCCAATTATCTGATTTCTTAA
TAGAGATACTTCGCATCATGTGTTCCGGAGTTTCTTTGTCCTCCTATAACGAAAAT
CTTCTACAACAGCTTTTTGAACTTTTTAAGCAAAAGAGCTGA >pgp7
ATGGGCTCGATGGCTTTCCATAAAAGTAGGTTGTTCTTAACTTTTGGGGACGCGT
CGGAAATTTGGTTATCTACTTTATCTCATCTAACTAGAAAAAATTATGCGTCTGG
GATTAACTTTCTTGTTTCTTTAGAGATTCTGGATTTATCGGAAACCTTGATAAAGG
CTATTTCTCTTGACCACAGCGAATCTTTGTTTAAAATCAAGTCTCTAGATGTTTTT
AATGGAAAAGTCGTTTCAGAGGCCTCTAAACAGGCTAGAGCGGCATGCTACATA
TCTTTCACAAAGTTTTTGTATAGATTGACCAAGGGATATATTAAACCCGCTATTCC
ATTGAAAGATTTTGGAAACACTACATTTTTTAAAATCCGAGACAAAATCAAAACA
GAATCGATTTCTAAGCAGGAATGGACAGTTTTTTTTGAAGCGCTCCGGATAGTGA
ATTATAGAGACTATTTAATCGGTAAATTGATTGTACAAGGGATCCGTAAGTTAGA
CGAAATTTTGTCTTTGCGCACAGACGATCTATTTTTTGCATCCAATCAGATTTCCT
TTCGCATTAAAAAAAGACAGAATAAAGAAACCAAAATTCTAATCACATTTCCTAT
CAGCTTAATGGAGGAGTTGCAAAAATACACTTGTGGGAGAAATGGGAGAGTATT
TGTTTCTAAAATAGGGATTCCTGTAACAACAAGTCAGGTTGCGCATAATTTTAGG
CTTGCAGAGTTCTATAGTGCTATGAAAAAAAAATTACTCCTAGAGTACTTCGTGC
AAGCGCTTTGA >pgp8
atgggtaaagggattttatctttgcagcaagaaatgtcgttagaatatagcgaaaagtcttatcaggaagttttAAAAATTCGCC
AAGAATCCTATTGGAAACGCATGAAAAGCTTCTCCTTATTCGAAGTTATTATGCA
TTGGACCGCATCACTCAACAAACATACTTGTAGATCATATCGAGGATCTTTTTTG
TCTTTAGAAAAGATTGGTCTATTGTCCTTGGATATGAATCTGCAAGAGTTTTCCCT
TTTAAATCATAATCTAATTCTAGATGCGATTAAAAAAGTTTCCTCTGCCAAGACT
TCTTGGACCGAAGGTACTAAACAAGTTCGAGCAGCAAGCTATATTTCCTTAACAA
GATTCCTAAACAGGATGACTCAAGGAATAGTCGCTATAGCGCAACCTTCTAAAC
AAGAAAATAGTCGAACATTTTTTAAAACCAGGGAAATAGTAAAAACAGATGCGA
TGAACAGTTTGCAAACAGCGTCCTTCCTAAAAGagctaaaaaaaatcaatgcccgggattggttgatc
gcccagacaatgctccaaggaggtaaacgctcctctgaagtcttaagcttggagattagtcagatttgtttccaacaagctaccatttctt
ctcccagcttaagaaccgtcagacagaaaagaggattattataacttatcctcagaagtttatgcactttctacaagagtacatcggtcaa
cgaagaggttttgtcttcgtaactcgctccggaaaaatggtggggttaaggcaaatcgcccgcacgttctctcaagcaggactacaagc
cttcgagcaaccgctgtgacggagtacaaacgtgcaatcccttttaagataaccccgcacgtgcctagggtgctcagactccgacata
atgaaggtcacaggacacgcaaccgcaaagatgatatttgcgtacgataaatcttctcgagaagacaacgcttcaaagaagatggctc
taatatag L2   L2R   L2Rp⁺   L2RpΔpgp3

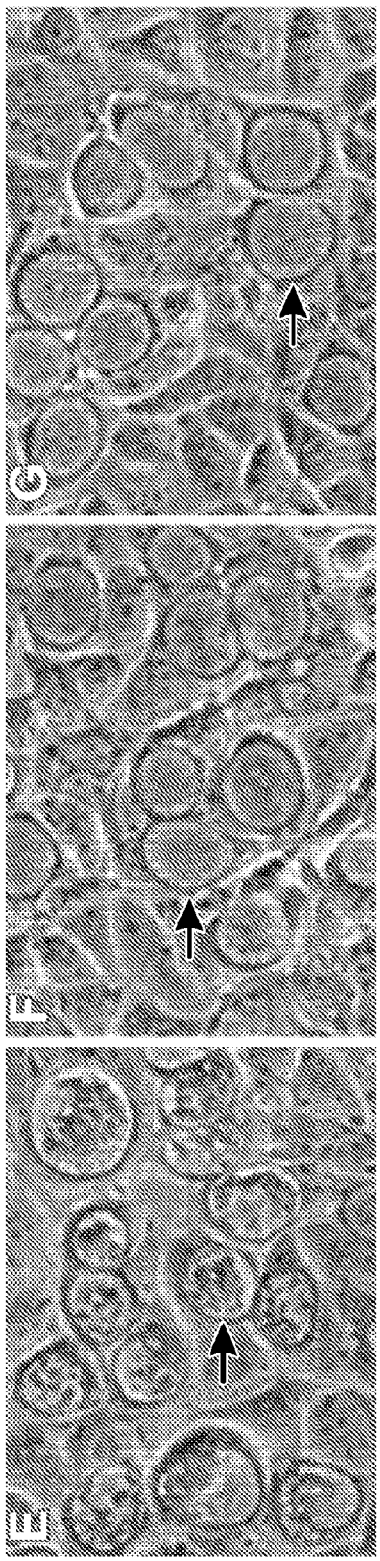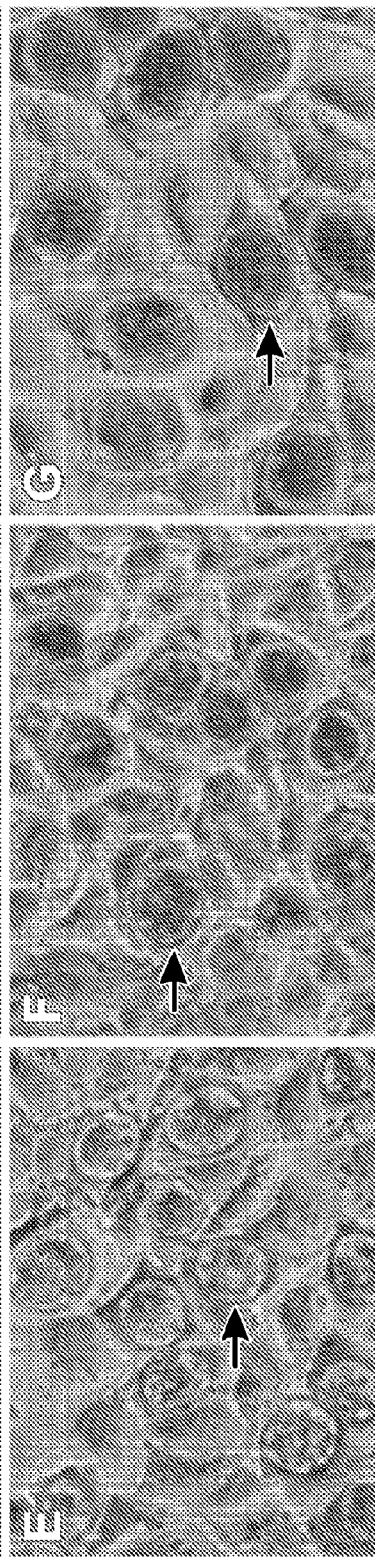
FIG. 2E  FIG. 2F  FIG. 2G
L2RpΔpgp4  L2RpΔpgp5  L2RpΔpgp7

FIG. 5A

Nucleic Acid Sequence of Plasmid J03321 (SEQ ID NO: 9):

```
   1 ggatccgtaa gttagacgaa attttgtctt tgcgcacaga cgatctattt tttgcatcca
  61 atcagatttc ctttcgcatt aaaaaaagac agaataaaga aaccaaaatt ctaatcacat
 121 ttcctatcag cttaatggaa gagttgcaaa aatacacttg tgggagaaat gggagagtat
 181 ttgtttctaa aatagggatt cctgtaacaa caagtcaggt tgcgcataat tttaggcttg
 241 cagagttcca tagtgctatg aaaataaaaa ttactcccag agtacttcgt gcaagcgctt
 301 tgattcattt aaagcaaaata ggattaaaag atgaggaaat catgcgtatt tcctgtcttt
 361 catcgagaca aagtgtgtgt tcttattgtt ctggggaaga ggtaattcct ctagtacaaa
 421 cacccacaat attgtgatat aattaaaatt atattcatat tctgttgcca gaaaaaacac
 481 ctttaggcta tattagagcc atcttctttg aagcgttgtc ttctcgagaa gatttatcgt
 541 acgcaaatat catctttgcg gttgcgtgtc ctgtgaccttt cattatgtcg gagtctgagc
 601 accctaggcg tttgtactcc gtcacagcgg ttgctcgaag cacgtgcggg gttatttaa
 661 aagggattgc agcttgtagt cctgcttgag agaacgtgcg ggcgatttgc cttaaccca
 721 ccattttttcc ggagcgagtt acgaagacaa aacctcttcg ttgaccgatg tactcctgta
 781 gaaagtgcat aaacttctga ggataagtta taataatcct ctttctgtc tgacggttct
 841 taagctggga gaaagaaatg gtagctgtt ggaaacaaat ctgactaatc tccaagctta
 901 agacttcaga ggagcgttta cctccttgga gcattgtctg ggcgatcaac caatcccggg
 961 cattgatttt ttttagctct tttaaaaaatg atgctgttttg caaactgttc atcgcatccg
1021 tttttactat tattccttga cctccggtcc ttaggaagg ttcgactatt tcttgttta gaaggttgcg
1081 ctatagcgac ttgtttagta gtcatcctgt aaaaaaaa gggaaaactc ttgcagattc atatccaagg
1141 ctgctcgaac ttgatttct aagacaaaa aagatcctcg atatgatcta atatgatcta caagtatgtt
1201 tcgcatctag gattagatta tgattttaaa tgcataataa cttcgaataa ggagaagctt ttcatcgtt
1261 acaatagacc aatcttttct aagacaaaaa aagatcctcg atatgatcta caagtatgtt
1321 tgttggagta tgcggtccaa tgcataataa cttcgaataa ggagaagctt ttcatcgtt
1381 tccaatagga ttcttggcga atttttaaaa gataaatcc agacttttca ctatattcta
1441 acgacattc ttgctgcaaa gataaatcc agacttttca ctatattcta
1501 ctatccgtaa aatgtcctga ttagtgaaat aatcaggttg ttaacaggat gtgatataac
1561 gtattttttt atataaacat gaaaactcgt tccgaaatag aaaatcgcat gcaagatatc
```

FIG. 5A (cont.)

```
1621 gagtatgcgt tgttaggtaa agctctgata tttgaagact ctactgagta tattctgagg
1681 cagcttgcta attatgagtt taagtgttct catcatataaa acatattcat agtatttaaa
1741 cacttaaaag acaatggatt acctataact gtagactcgg cttgggaaga gcttttgcgg
1801 cgtcgtatca aagatatgga caaatcgtat ctcgggttaa tgttgcatga tgctttatca
1861 aatgacaagc ttagatccgt ttctcatacg gttttcctcg atgatttgag cgtgtgtagc
1921 gctgaagaaa atttgagtaa tttcattttc cgctcgttta atgagtacaa tgaaaatcca
1981 ttgcgtagat ctccgttcct attgcttgag cgtatagcta gaagcttga tagtgctata
2041 gcaaagactt tttctattcg cagcgctaga ggccggtcta tttatgatat attctcacag
2101 tcagaaattg gagtgctggc tcgtataaaa aaaagacgag tagcgttctc tgagaatcaa
2161 aattctttct ttgatgctt cccaacagga tacaaggata ttgatgataa aggagttatc
2221 ttagctaaag gtaatttcgt gattatagca gctaaacagc ctataggaa aacagcttta
2281 gctatagaca tggcgcggtt tcttgcggtt actcaacagc gtagagttgg tttcctatct
2341 ctagaaatga gcgcaggtca aattgttgag cggattattg ctaatttaac aggaatatct
2401 ggtgaaaaat tacaaagagg ggatctctct aaagaagaat tattccgagt agaagaagct
2461 ggagaaacgg ttagagaatc acattttat atctgcagtg atagtcagta taagcttaac
2521 ttaatcgcga atcagatccg gttgctgaga aaagaagatc gagtagacgt aatatttatc
2581 gattacttgc agttgatcaa gttgctgaga ctcatcggtt gtcaaaatga aatagcagat
2641 atatctagaa ccttaagagg tttagcctca gagctaaaca ttcctatagt ttgtttatcc
2701 caactatcta gaaaagttga ggatagagca aataaaagtt ccatgctttc agatttgcga
2761 gacacggtc aaatagagca agacgcagat gtgatttgt ttatcaatag gaaggaatcg
2821 tcttctaatt gtgagataac tgttgggaaa aatagacatg aatagacatg ctcttcggta
2881 ttacatttcg atccaaaaat tagtaaattc tccgctatta aaaagtatg gtaaattata
2941 gtaacttgcca cttcatcaaa agtcctatcc accttgaaaa tcagaagtt ggaagaagac
3001 ctggtcaatc tattaagata tctcccaaat tggctcaaaa tgggatggta gaagttatag
3061 gtctttgattt tctttcatct cattaccatg cattagcagc tatccaaaga ttactgaccg
3121 caacgaatta caagggaac acaaaagggg ttgttttatc ttacaaaac aatagttttc
3181 aatttgaagg atggatacca agaatccgtt ttacaaaaac tgaattctta gaggcttatg
3241 gagttaagcg gtataaaaca tccagaaata agtatgagtt tagtggaaaa gaagctgaaa
```

FIG. 5A (cont.)

```
3301 ctgctttaga agccttatac catttaggac atcaaccgtt tttaatagtg gcaactagaa
3361 ctcgatggac taatggaaca caaatagtag accgttacca aactcttact ccgatcatta
3421 ggatttacga aggatggaa gtttaactg acgaagaaa tatagatata gacttaacac
3481 cttttaattc accacctaca cggaaacata aagggttcgt tgtagagcca tgtcctatct
3541 tggtagatca aatagaatcc tactttgtaa tcaagcctgc aaatgtatac caagaaataa
3601 aaatgcgttt cccaaatgca cttacacatt tatcgactgg gtgattacag
3661 cagctgcgaa aagagacga aggataacta ttggccagaa aacttgttat
3721 taaacgttaa cgttaaaagt cttgcatata ttttaaggat atctgtacaa
3781 ggaactggaa aaaatcgag ttagctatcg ataaatgtat gaatcggtac attcagcttg
3841 gctggttatc tagaagaaa cgcattgaat ttctggattc agaaatcgcc tctaaaaaag
3901 aaattctata gagcgctttg aagcgttttg aagaataaac aaagaacaaa
3961 tggaacaatt agaacaagaa tctattaatt aataagcaagc ttgaaactaa aaacctaatt
4021 tatttaaagc tcaaaataa aaagagtttt aaaatgggaa attctggttt ttatttgtat
4081 aacactgaaa actgcgtctt tgctgataat atcaaagttg ggcaaatgac agagccgctc
4141 aaggaccagc aaataatcct tgggacaaca tcaacacctg tcgcagccaa aatgacagct
4201 tctgatggaa tatctttaac agtctccaat aattcatcaa ccaatgcttc tattacaatt
4261 ggtttggatg cggaaaagc ttaccagctt attctagaaa agttgggaga tcaaattctt
4321 gatggaattg ctgatactat tgttgatagt acagtccaag atattttaga caaaatcaaa
4381 acagaccct ctctaggttt gttgaaagct tttaacaact taataaaatt
4441 caatgcaacg ggttattcac tcccagtaac attgaaactt tcttagtctc agcagatatt
4501 ggaaaattca cagtcacacc caaagctct gggagcatgt ctttagtctc tgattctaag
4561 attgcatcaa gaatggaagg cggcgttgtt ctagctttgg tacgagaagg tgattctaag
4621 ccctgcgcga ttagttatgg atactcctca gcattccta attatgtag tctaagaacc
4681 agtattacta atacaggatt gactccgaca acgtattcat tacgtgtagg atattttagaa
4741 agcggtgtgg tatgggttaa tgcccttct aatgcaatg atattttagg aataacaaat
4801 acttctaatg tatctttt agaggtaata cctcaaacaa acgcttaaac aattttatt
4861 ggattttct tataggtttt agatttagag aaaacagttc gaattacggg gtttgttatg
4921 caaataaaa gaaaagtgag ggacgatttt attaaaattg ttaaagatgt gaaaaaagat
```

FIG. 5A (cont.)

```
4981 ttcccgaat tagacctaaa aatacgagta aacaaggaaa aagtaacttt cttaaattct
5041 ccctagaaac tctaccataa tctaccatca aagtgtctca ctaattctag acaaatagaa
5101 aactctttag gattattccc agactctcct gttcttgaaa gactgcttca taacagttta
5161 aagctaaaaa aggctttgat tatgcttatc ttgtctagaa aagacatgtt ttccaaggct
5221 gaatagacaa cttactctaa cgttggagtt aacactttct ccttagttt ttgctcttt
5281 aagggaggaa ctgaaaaaac aacactttct ctaaacgtgg gatgcaactt ggcccaattt
6901 ctttgcaact cttggtggta gactttgcaa ctccttggtt tagacttggt cataatggac
5341 ttagggaaaa aagtgttact tgctgaccta gaccccgcaat ccaatttatc ttctggattg
5401 gggctagtg tcagaagtga ccaaaaaggc ttgcacgaca tagtatacac atcaaacgat
5461 ttaaatcaa tcatttgcga aacaaaaaaa gatagtgtgg acctaattcc tgcatcattt
5521 tcatccgaac agtttagaga attggatatt cataagggac ctagtaacaa cttaaagtta
5581 tttctgaatg agtactgcgc tccttttat gacatctgca taatagacac tccacctagc
5641 ctaggagggt taacgaaaga agctttttgtt gcaggagaca aattaattgc ttgtttaact
5701 ccagaacctt tttctattct agggttacaa aagatacgtg aattcttaag ttcgtcgga
5761 aaacctgaag aagaacacat tcttggaata gctttgtctt tttgggatga tcgtaactcg
5821 actaaccaaa tgtatataga cattatcgag tctatttaca aaaacaagct tttttcaaca
5881 aaaattcgtc gagatatttc tctcagccgt tctcttctta aagaagattc tgtagctaat
5941 gtctatccaa attctagggc tcgcagaagat attctgaagt taacgcatga aatagcaaat
6001 atttttgcata tcgaatatga acgagattac tctcagagga caacgtgaac aaactaaaaa
6061 aagagcgga tgtcttttt aaaaaaaatc aaactgccgc ttctctagat tttaagaaga
6121 cgcttccctc cattgaacta ttctcagcaa ctttgaattc tgaggaaagt cagagtttgg
6181 atcgattatt tttatcagag tcccaaaact attcggatga agaattttat caagaagaca
6241 tcctagcggt aaaactgctt actggtcaga taaaatccat acagaagcaa cacgtacttc
6301 ttttagaga aaaatctat aatgctagaa aaatcctgag taaggatcac ttctcctcaa
6361 caactttttc atcttggata gagttagttt ttagaactaa gtcttctgct tacaatgctc
6421 ttgcatatta cgagcttttt ataaacctcc ccaaccaaac tctacaaaaa gagtttcaat
6481 cgatcccta taaatccgca tatattttgg ccgctagaaa aggcgattta aaaaccaagg
6541 tcgatgtgat agggaaaagta tgtggaatgt cgaactcatc ggcgataagg gtgttggatc
```

FIG. 5A (cont.)

```
6601 aatttcttcc ttcatctaga aacaaagacg ttagagaaac gatagataag tctgattcag
6661 agaagaatcg ccaattatct gatttcttaa tagagatact tcgcatcatg tgttccggag
6721 tttctttgtc ctcctataac gaaaatcttc tacaacagct tttgaactt tttaagcaaa
6781 agagctgatc ctccgtcagc tcatatatat atatctatta tatatatata tttagggatt
6841 tgatttcacg agagagattt gcaactcttg gtggtagact ttgcaactct tggtggtaga
6901 tttgttaaa aaatttatta aaatcttaga gctccgattt tgaatagctt tggttaagaa
6961 aatgggctcg atggctttcc ataaaagtag attgtttta acttttgggg acgcgtcgga
7021 aatttgtta tctacttat cttatctaac taaaaaaaat tatgcgtctg ggattaactt
7081 tcttgtttct ttagagattc tggatttatc ggaaaccttg ataaggcta tttctcttga
7141 ccacagcgaa tcttttgtta aaatcaagtc tctagatgtt tttaatggaa aagttgtttc
7201 agaggcatct aaacaggcta gagcggcatg ctacatatct ttcacaaagt tttgtatag
7261 attgaccaag ggatatatta aacccgctat tccattgaaa gatttggaa acactacatt
7321 tttaaaatc cgagacaaaa tcaaaacaga atcgattct aagcaggaat ggacagtttt
7381 tttgaagcg ctccggatag tgaattatag agactattta atcggtaaat tgattgtaca
7441 ag
7501
```

FIG. 5B

Corresponding Amino Acid Sequence of Pgp1 (SEQ ID NO: 10):

MKTRSEIENRMQDIEYALLGKALIFEDSTEYILRQLANYEFKCSHHKNIFIVFKHLKDNGLPITVDSAWEELLRRRIKD
MDKSYLGLMLHDALSNDKLRSVSHTVFLDDLSVCSAEENLSNFIFRSFNEYNENPLRRSPFLLEFIKGRLDSAIAKTF
SIRSARGRSIYDIFSQSEIGVLARIKKKRVAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVLFINRKESSSNCEITVGKNRHGSVFSSVLHFDPKISKFSAIKKVW

FIG. 5C
Corresponding Amino Acid Sequence of Pgp2 (SEQ ID NO: 11):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPPTRKHKGFVVEPCPILVDQIESYFVIKPANVYQEIKMRFPNASKYAYT
FIDWVITAAAKKRRKLTKDNSWPENLLNVNVKSLAYILRMNRYICTRNWKKIELAIDKCIEIAIQLGWLSRKKRIEFL
DSSKLSKKEILYLNKERFEEITKKSKEQMEQLEQESIN

FIG. 5D
Corresponding Amino Acid Sequence of Pgp3 (SEQ ID NO: 12):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDIDKIKTDPSLGLLKAFNNFPITNKIQCNGLFTPSNIETLLGGTEIGKFTVTPKS
SGSMFLVSADIIASRMEGGVVLAIVREGDSKPCAISYGYSSGIPNLCSLRTSITNTGLTPTTYSLRVGGLESGVVWVNA
LSNGNDILGITNTSNVSFLEVIPQTNA

FIG. 5E
Corresponding Amino Acid Sequence of Pgp4 (SEQ ID NO: 13):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 5F
Corresponding Amino Acid Sequence of Pgp5 (SEQ ID NO: 14):

MGCNLAQFLGKKVLLADLDPQSNLSSGLGASVRSDQKGLHDIVYTSNDLKSIICETKKDSVDLIPASFSSEQFRELDIH
RGPSNNLKLFLNEYCAPFYDICIIDTPPSLGGLTKEAFVAGDKLIACLTPEPFSILGLQKIREFLSSVGKPEEHILGI
ALSFWDDRNSTNQMYIDIIESIYKNKLFSTKIRRDISLSRSLLKEDSVANVYPNSRAAEDILKLTHEIANILHIEYERD
YSQRTT

FIG. 5G

Corresponding Amino Acid Sequence of Pgp6 (SEQ ID NO: 15):

MNKLKKEADVFFKKNQTAASLDFKKTLPSIELFSATLNSEESQSLDRLFLSESQNYSDEEFYQEDILAVKLLTGQIKSI
QKQHVLLIGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDFLIEILRIMCSGVSLSSYNENLLQ
QLFELFKQKS

FIG. 5H

Corresponding Amino Acid Sequence of Pgp7 (SEQ ID NO: 16):

MGSMAFHKSRLFLTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISIMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 5I

Corresponding Amino Acid Sequence of Pgp8 (SEQ ID NO: 17):

MGKGILSLQQEMSLEYSEKSYQEVLKIRQESYWKRMKSFSLFEVIMHWTASLNKHTCRSYRGSFLSLEKIGLLSLDMNL
QEFSLINHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 6A

Nucleic Acid Sequence of Plasmid NC_010286 (SEQ ID NO: 18):

```
   1 cgattaaatt aagcttatac tgactatcac tgcagatata aaaatgtgat tctctaactg
  61 tttctccagc ttcttctact cggaataatt cttctttaga gagatccct ctttgtaatt
 121 tttcaccaga tattcctgtt aaattagcaa taatccgctc aacaatttga cctgcgctca
 181 tttctagaga taggaaacca actctacgct gttgagtaac cgcaagattt atcgccatgt
 241 ctatagctaa agcagttttc cctatagatg gcctagctgc tataatcacg aaattacctt
 301 tagctaagat aactccttta tcatcaatat ccttgtatcc tgttgggaag gcatcaaaga
 361 aagaattttg attctcagag aacgttgctc gtcttttttt tatacgagcc agcactccaa
 421 tttctgactg tgagaatata tcataaatag accggcctct agcgctgcga atagaaaaag
 481 tctttgctat agcactgtca agccttccct aagcaataga aacggagatc
 541 tacgcaatgg attttcattg tactcattaa acgagcggaa aatgaaatta ctcaaatttt
 601 cttcagcgct acacacgctc aaatcatcga ggaaaaccgt atgagaaacg gatctaagct
 661 tgtcatttga taaagcatca tgcaacatta acccgagata cgatttgtcc atatctttga
 721 tacgacgccg caaaagctct tcccaagccg agtctacagt tataggtaat ccattgtctt
 781 ttaagtattt aaatactatg aatatgtttt tatgatgaga acacttaaac tcataattag
 841 caagctgcct cagaatatac tcagtagagt cttcaaatat cagagcttta cctaacaacg
 901 catactcgat atcttgcatg cgattttcta tttcggaacg agtttctcatg tttatataaa
 961 aaaataccga gcgtgctatc ctgttaacaa ctgattatt tcactaatca ggacattta
1021 cggataggtt atatcacgag ggatttcatg ggtaaaggga tttatctttt gcagcaagaa
1081 atgtcgttag aatatagcga aaagtcttat caggaagttt taaaaattcg ccaagaatcc
1141 tattggaaac gcatgtag cttctcctta ttcgaagtta ttatgcattg gaccgcatca
1201 ctcaacaaac atacttgtag atcatatcga ggatcttttt tgtctttaga aaagattggt
1261 ctattgtcct tggatatgaa tctgcaagag ttttcccttt taaatcataa tctaattcta
1321 gatgcgatta aaaaagtttc ctctgccaag acttcttgga ccgaagtac taaacaagtt
1381 cgagcagcaa gctatatttc cttaacaaga ttcctaaaca ggatgactca aggaatagtc
1441 gctatagcgc aaccttctaa acaagaaaat agtcgaacat ttttaaaac caggaaaata
1501 gtaaaaacag atgcgatgaa cagtttgcaa acagcgtcct tcctaaaaga gctaaaaaaa
1561 atcaatgccc gggattggtt gatcgcccag acaatgctcc aaggagtaa acgctcctct
```

FIG. 6A (cont.)

```
1621  gaagtcttaa  gcttggagat  tagtcagatt  tgtttccaac  aagctaccat  ttctttctcc
1681  cagcttaaga  accgtcagac  agaaaagagg  attattataa  cttatcctca  gaagtttatg
1741  cactttctac  aagtacat    cggtcaacga  agaggttttg  tcttcgtaac  tcgctccgga
1801  aaaatggtgg  ggttaaggca  aatcgcccgc  acgttctctc  aagcaggact  acaagctgca
1861  atcccttta   agataacccc  gcacgtgctt  cgagcaaccg  ctgtgacgga  gtacaaacgc
1921  ctagggtgct  cagactccga  cataatgaag  gtcacaggac  acgcaaccgc  aaagatgata
1981  tttgcgtacg  ataaatcttc  tcgagaagac  aacgcttcaa  agaagatggc  tctaatatag
2041  cctaaaagtg  tttttctgg   caacagaata  tgaatatat   tttaattata  tcacaatatt
2101  ggggtgttt   gtactagagg  acttacctct  tccccagaac  aataagaaca  cacactttgt
2161  ctcgatgaaa  gacagaaat   acgcatgatt  tcctcatctt  ttaatcctat  ttgctttaaa
2221  tgaatcaaag  cgcttgcacg  aagtactcta  ggagtaattt  ttatttttcat agcactatag
2281  aactctgcaa  gcctaaaatt  atgcgcaacc  tgacttgttg  ttacaggaat  ccctatttta
2341  gaaacaaata  ctctcccatt  tctcccacaa  gtgtattttt  gcaactcctc  cattaagctg
2401  ataggaaatg  tgattagaat  tttggtttct  ttattctgtc  ttatttttaat gcgaaaggaa
2461  atctgattgg  atgcaaaaaa  tagatcgtct  gtgcgcaaag  acaaatttc   gtctaactta
2521  cggatccctt  gtacaatcaa  tttaccgatt  aaatagtctc  tataattcac  tatccggagc
2581  gcttcaaaaa  aaactgtcca  ttcctgctta  gaaatcgatt  ctgttttgat  tttgtctcgg
2641  attttaaaaa  atgtagtgtt  ttcaaaatct  ttcaatggaa  tagcgggttt  aatatatccc
2701  ttggtcaatc  tatacaaaaa  ctttgtgaaa  gatatgtagc  atgccgctct  agcctgttta
2761  gaggcctctg  aaacgactt   tccattaaaa  acatctagag  acttgatttt  aaacaaagat
2821  tcgctgtggt  caagagaaat  agcctttatc  aaggttttcg  ataaatccag  aatctctaaa
2881  gaaacaagaa  agttaatccc  agacgcataa  ttttttctag  ttagatgaga  taaagtagat
2941  aaccaaattt  ccgacgcgtc  cccaaagtt   aagaacaacc  tactttatg   gaaagccatc
3001  gagcccattt  tcttaaccaa  agctattcaa  aatcggagct  ctaagatttt  aagaaatttt
3061  tcaacaaaag  tccattatga  ccaagtctac  caccaagagt  tgcaaagtct  accaccaaga
3121  gttgcaaagt  ctaccaccac  gagttgcaaa  gtctaccacc  aagagttgca  aatctctctc
3181  gtaaatcaa   atccctaaat  atatatatat  aatagatata  tatatgagct  gacggaggat
3241  cagctctttt  gcttaaaaag  ttcaaaaagc  tgttgtagaa  gatttcgtt   ataggaggac
```

FIG. 6A (cont.)

```
3301 aagaaactc cggaacacat gatgcgaagt atctctatta agaaatcaga taattggcga
3361 ttcttctctg aatcagactt atctatcgtt tctctaacgt tctgttttct agatgaagga
3421 agaaattgat ccaacaccct tatcgccgat gagttcgaca ttccacatac tttccctatc
3481 acatcgacct tggtttttaa atcgcctttt ctagcggcca aaatatatgc ggatttatag
3541 gggatcgatt gaaactcttt ttgtagagtt tggttgggga ggtttataaa aagctcgtaa
3601 tatgcaagag cattgtaagc agagaactta gttctaaaaa ctaactctat ccaagatgaa
3661 aaagttgttg aggagaagtg atccttactc aggattttt tagcattata gatttttct
3721 cctaaaagaa gtacgtgttg cttctgtatg gaccagtaag cagtttacc
3781 gctaggatgt cttcttgata aaattcttca tccgaatagt tttgggactc tgataaaaat
3841 aattgatcca aactcgact ttcctcagaa ttcaagttg ctgagaatag ttcaatgaa
3901 ggaagcgtct tcttaaaatc taagaaagcg gcagtttgat tttttaaa aaagacattc
3961 gcttcttttt ttagtttgtt cacgttgtcc tctgagagta atctcgttca tattcgatat
4021 gcaaaatatt tgctatttca tgcgttaact tctgcgcgcc ctagaattg
4081 gatagacatt agctacaaga tcttctttaa gaagagaacg gctgagagaa atatctcgac
4141 gaattttgt tgaaaaaagc ttgttttgt aaatagactc gataatgtct atatacattt
4201 ggttagtcga gttacgatca tcccaaaaag acaaagctat tccaagaatg tgttcttctt
4261 cagttttcc gaccgaactt aagaattcac gtatctttg taacctaga atagaaaaag
4321 gttctggagt taaacaagca attaatttgt ctcctgcaac ctatcttct ttcgttaacc
4381 ctcctaggct aggtggagtg tctattatgc agatgtcata aaaaggagcg cagtactcat
4441 tcagaaataa ctttaagttg ttactaggtc ctctatgaat atccaattct ctaaactgtt
4501 cggataaaaa tgatgcagga attaggtcca cactatcttt tttgttttcg caaatgattg
4561 attttaaatc gtttgatgtg tatactatgt cgtgtaagcc ttttggtta cttctgacac
4621 tagcccccaa tccagaagat gcggattag gcggtctag gtcagcaagt aacacttttt
4681 tcccctaaaa ttgggccaag ttgcatccca cgtttagaga agtgtgtt tttccagttc
4741 ctcccttaaa agagcaaaaa actaaggtgt gcaaatcaac tccaacgtta gagtaagtta
4801 tctattcagc cttggaaaaac atgtcttttc tagacaagat aagcataatc aaagccttt
4861 ttagctttaa actgttatcc tctaattttt caagaacagg agagtctggg aataatccta
4921 aagagttttc tatttgttga agcagtccta gaattagtga gacactttta tggtagagtt
```

FIG. 6A (cont.)

```
4981 ctaaggaga atttaagaaa gttactttt ccttgtttac tcgtattttt aggtctaatt
5041 cgggaaatc tttttcaca tctttaacaa tctttaataaa atcgtccctc actttgcttt
5101 tattttgcat aacaaaccc gtaattcgaa cttttctc taaatataaa acctataaga
5161 aaaatccaat aaaaattgtt taagcgtttg tttgaggtat tacctccaaa aaagatacat
5221 tagaagtatt tgttattcct aaaatatcat tgccattaga aagggcatta accataccca
5281 caccgctttc taaaccgcct acacgtaatg aatacgttgt cggagtcaat cctgtattaa
5341 taattctggt tcttagacta cataaattag gaacgcctga tgagtatcca taactaatcg
5401 cgtaggctt agaatcacct tctcgtacca aagctagaac aacgccgcct tccattcttg
5461 atgcaataat atctgctgag actaagaaca tgctcccaga gctttgggt gtgactgtga
5521 atttcctat ttcagttcct cctaataaag ttcaatgtt cctgggagtg aataacccgt
5581 tgcattgaat tttattagtg attggaaagt tgttaaaagc tttcaacaaa cctagagaag
5641 ggtctgttgt gattttgtct aaaatatctt ggactgtact atcaacaata gtatcagcaa
5701 ttccaccaag aatttgatct cccaactttt ctagaataag ctggtaagct tttccgcat
5761 ccaaaccaat tgtaataga gcattggttg atggattatt ggagactgtt aaagatattc
5821 catcagagc tgtcatttg gctgcgacag gtgttgatgt tgtcccaagg attattgct
5881 ggtccttgag cggctctgtc attgcccaa cttgatatt atcagcaaag acgcagtttt
5941 gagtgttata caaataaaaa ccagaatttc ccattttaaa actctttttt attttgagct
6001 ttaaataaat taggttttta gtttcaagtt tgctattaat taatagattc ttgttctaat
6061 tgttccattt gttcttaga tttcttagtt atttcttcaa aacgctcttt atttagatat
6121 agaatttctt tttagaagag tttagaagaa tccagaaatt caatgcgttt tcttctagat
6181 aaccaaccaa gctgaatggc gatttctata catttatcga tagctaactc gatttttttc
6241 cagttccttg tacaaatgta ccgattcatc cttaaatat atgcaagact tttaacgtta
6301 acgtttaaga acaagttttc tggccaagaa ttatcctag ttaattttcg tctctttttc
6361 gcagctgctg taatcaccca gtcgataaat gtgtaagcat actttgatgc atttgggaag
6421 cgcattttta tttcttggta tacattgca ggcttgatta caaagtagga ttctatttga
6481 tctaccaaga taggacatgg ctctacaacg aaccctttat gtttccgtgt agatggtgaa
6541 ttaaaaggtg ttaagtctat atctatattt tcttcgtcag ttaaccttc ccatccttcg
6601 taaatcctaa tgatcggaga aagagtttgg taacgtctca ctattgtgt tccattagtc
```

FIG. 6A (cont.)

```
6661  catcgagttc  tagttgccac  tattaaaaac  ggttgatgtc  ctaaatggta  taaggcttct
6721  aaagcagttt  cagcttcttt  tccactaaac  tcatacttat  ttctggatgt  tttataccgc
6781  ttaactccat  aagcctctaa  gaattcagtt  tttgtaaaac  ggattcttgg  tatccatcct
6841  tcaaattgaa  aactatttga  ttctctggat  aaaacaaccc  cttttgtgtt  cccttgtaa
6901  ttcgttgcag  tcagcaatct  ttggatagct  gctaatgcat  ggtaatgaga  tgaaagaaaa
6961  tcaagaccta  taacttctac  catcccattt  tgagccaatt  tgggagatat  cttaatagat
7021  tgaccaggtc  ttcttccaaa  cttctgattt  tcaaggtgga  taggactttt  gatgaagtgg
7081  cagttactat  aatttaccat  acttttttaa  tagcggagaa  tttactaatt  tttggatcga
7141  aatgtaatac  cgaagagaaa  accgatccat  gtctatttt   cccaacagtt  atctcacaat
7201  tagaagacga  ttccttccta  ttgataaaca  aaatcacatc  tgcgtcttgc  tctatttgac
7261  cgctgtctcg  caaatctgaa  agcatgggaa  cttattttgc  tctatcctca  acttttctag
7321  atagtttggga  taaacaaact  ataggaatgt  ttagctctga  ggctaaacct  cttaagttc
7381  tagatatatc  tgctatttca  tttgacgat   ttctccaac   cgatgagttg  atcaactgca
7441  agtaatcgat  aaatattacg  tctactcgat  cttcttttct  cagcaaccgg  atctgattcg
```

FIG. 6B

Corresponding Amino Acid Sequence of Pgp1 (SEQ ID NO: 19):

```
MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLREDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW
```

FIG. 6C

Corresponding Amino Acid Sequence of Pgp2 (SEQ ID NO: 20):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 6D

Corresponding Amino Acid Sequence of Pgp3 (SEQ ID NO: 21):

MGNSGFYLYNTQNCVFADNIKVGQMTEPLKDQQIILGTTSTPVAAKMTASDGISLTVSNNPSTNASITIGLDAEKAYQL
ILEKLGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVWWVNA
LSNGNDILGITNTSNVSFLEVIPQTNA

FIG. 6E

Corresponding Amino Acid Sequence of Pgp4 (SEQ ID NO: 22):

MQNKSKVRDDFIKIVKDVKKDFPELDLKIRVNKEKVTFLNSPLELYHKSVSLILGLLQQIENSLGLFPDSPVLEKLEDN
SLKLKKALIMLILSRKDMFSKAE

FIG. 6F

Corresponding Amino Acid Sequence of Pgp5 (SEQ ID NO: 23):

MGCNLAQFLGKKVLLADLDPQSNLSSGLGASVRSNQKGLHDIVYTSNDLKSIICETKKDSVDLIPASFLSEQFRELDIH
RGPSNNLKLFLNEYCAPFYDICIIDTPPSLGGLTKEAFVAGDKLIACLTPEPFSILGLQKIREFLSSVGKPEEHILGI
ALSFWDDRNSTNQMYIDIIESIYKNKLFSTKIRRDISLSRSLLKEDSVANVYPNSRAAEDILKLTHEIANILHIEYERD
YSQRTT

FIG. 6G

Corresponding Amino Acid Sequence of Pgp6 (SEQ ID NO: 24):

MNKLKKEANVFFKKNQTAASLDFKKTLPSIELFSATLNSEESQSLDQLFLSESQNYSDEEFYQEDILAVKLLTGQIKSI
QKQHVLLIGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 6H

Corresponding Amino Acid Sequence of Pgp7 (SEQ ID NO: 25):

MGSMAFHKSRLFLTFGDASEIWLSTISHLTRKNYASGINFLVSLEILDLSETLIKAISLDHSESLFKIKSLDVENGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFYSAMKIKITPRVLRASALIHLKQIGLKDEEIMRISCLSSRQSVCSYCSGEEVSPLVQTPPIL

FIG. 6I

Corresponding Amino Acid Sequence of Pgp8 (SEQ ID NO: 26):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 7A

Nucleic Acid Sequence of Plasmid NC_010285 (SEQ ID NO: 27):

```
   1 tcctaggcta gtggagtgt ctattatgca gatgtcataa aaaggagcgc agtactcatt
  61 cagaaataac tttaagttgt tactaggtcc tctatgaata tccaattctc taaactgttc
 121 ggataaaaat gatgcaggaa ttaggtccac actatctttt tttgtttcgc aaatgattga
 181 ttttaaatcg tttgatgtgt atactatgtc gtgtaagcct ttttggttac ttctgacact
 241 agccccaat ccagaagata aattggattg cgggtctagg tcagcaagta acactttttt
 301 ccctaaaaat tgggccaagt tgcatcccac gtttagagaa agtgttgttt ttccagttcc
 361 tccctaaaaa gagcaaaaaa ctaaggtgtg caaatcaact ccaacgttag agtaagttat
 421 ctattcagcc ttggaaaaca tgtctttttct agacaagata agcataatca aagccttttt
 481 tagctttaaa ctgttatcct ctaattttc aagaacagga gagtctggga ataatcctaa
 541 agagtttttct atttgttgaa gcagtcctag aattagtgag acacttttat ggtagagttc
 601 taagggagaa tttaagaaag ttactttttc cttgtttact cgtatttta ggtctaattc
 661 ggggaaatct tttttcacat ctttaacaat tttaataaaa tcgtccctca cttgtctttt
 721 atttgcata acaaacccg taattcgaac ttttttctct aaatataaaa cctataagaa
 781 aaatccaata aaaattgttt aagcgttttt ttgaggtatt acctccaaaa aagatacatt
 841 agaagtattt gttattccta aaatatcatt gccattagaa agggcattaa cccataccac
 901 accgcttttct aaaccgccta cacgtaatga atacgttgtc ggagtcaatc ctgtattaat
 961 aattctggtt cttagactac ataaattagg aacgcctgat gagtatccat aactaatcgc
1021 gtagggctta gaatcaccct ctcgtaccaa agctaaaca acgcccgcctt ccattcttga
1081 tgcaataata tctgctgaga ctaagaacat gctcccagag ctttgggtg tgactgtgaa
1141 ttttcctatt tcagttcctc ctaataaagt ttcaatgttc ctgggagtga ataacccgtt
1201 gcattgaatt ttattagtga ttggaaagtt gttaaaagct ttcaacaaac ctagagaagg
1261 gtctgtgtg attttgtcta aaatatcttg gactgtacta tcaacaatag tatcagcaat
1321 tccaccaaga atttgatctc ccaacttttc tagaataagc tggtaagctt tttccgcatc
1381 caaaccaatt gtaatagaag cattgtttga tggattattg gagactgtta aagatattcc
1441 atcagaagct gtcattttgg ctgcgacagg tgttgatgtt gtcccaagga ttatttgctg
1501 gtccttgagc ggctctgtca tttgcccaac tttgatatta tcagcaaaga cgcagttttg
1561 agtgttatac aataaaaac cagaatttcc catttttaaa ctcttttta ttttgagctt
```

FIG. 7A (cont.)

```
1621 taaataaatt aggtttttag tttcaagttt gctattaatt aatagattct tgttctaatt
1681 gttccatttg ttctttagat ttctttagtta tttcttcaaa acgctcttta tttagatata
1741 gaatttcttt tttagagagt ttagaagaat ccagaaattc aatgcgtttt cttctagata
1801 accaaccaag ctgaatggcg atttctatac atttatcgat agctaactcg atttttttcc
1861 agttccttgt acaaatgtac cgattcatcc ttaaaatata tgcaagactt ttaacgttaa
1921 cgtttaagaa caagtttttct ggccaagaat taattttcgt ctcttttttcg
1981 cagctgctgt aatcaccag tcgataaatg tgtaagcata ctttgatgca tttggaagc
2041 gcatttttat ttcttggtat acattgcag gcttgattac aaagtaggat tctatttgat
2101 ctaccaagat aggacatggc tctacaacga acccttttatg tttccgtgta gatggtgaat
2161 taaaggtgt taagtctata tctatatttt cttcgtcagt taaaccttcc catcctcgt
2221 aaatcctaat gatcggagaa agagtttggt aacggtctac tatttgtgtt ccattagtcc
2281 atcgagttct agttgccact attaaaaacg gttgatgtcc taaatggtat aaggcttcta
2341 aagcagtttc agctctttt ccactaaact catactatt tctgatgtt ttataccgct
2401 taactccata agcctctaag aattcagttt ttgtaaaacg gattcttggt atccatcctt
2461 caaattgaaa actatttgat tctctggata aaacaaccc tttgtgttc cccttgtaat
2521 tcgttgcagt cagcaatctt tggatagctg ctaatgcatg gtaatgagat gaaagaaaat
2581 caagacctat aacttctacc atcccatttt gagccaattt ttaatagatt
2641 gaccaggtct tcttccaaac ttctgatttt caaggtggat gggagatatc atgaagtggc
2701 agttactata atttaccata ctttttttaat agcggagaat aggactttg ttggatcgaa
2761 atgtaataac gaagagaaaa ccgatccatg tctattttc ccaacagtta tctcacaatt
2821 agaagacgat tccttcctat tgataaacaa aatcacatct gcgtcttgct ctatttgacc
2881 gctgtctcgc aaatctgaaa gcatgggaac tttatttgct ctaacctcaa cttttctaga
2941 tagttgggat aaacaaacta taggaatgtt tagctctgag gctaaactc ttaaggttct
3001 agatatatct gctatttcat tttgacgatt ttctccaacc gatgagttga tcaactgcaa
3061 gtaatcgata aatattacgt ctactcgatc ttctttttctc agcaaccgga tctgattcgc
3121 gattaaatta agcttatact gactatcact gcagatataa aaatgtgatt ctctaactgt
3181 ttctccagct tcttctactc ggaataattc ttctttagag agatccctc tttgtaattt
3241 ttcaccagat attcctgtta aattagcaat aatccgctca acaatttgac ctgcgctcat
```

FIG. 7A (cont.)

```
3301  ttctagagat aggaaaccaa ctctacgctg ttgagtaacc gcaagattta tcgccatgtc
3361  tatagctaaa gcagtttcc ctatagatgg cctagctgct ataatcacga aattaccttt
3421  agctaagata actcctttat catcaatatc cttgtatcct gtggaagg catcaaagaa
3481  agaattttga ttctcagaga acgttgctcg tctttttt atacgagcca gcactccaat
3541  ttctgactgt gagaatatat cataaataga ccggcctcta gcgctgcgaa tagaaaagt
3601  ctttgctata gcactgtcaa gccttccctt tatacgctca agcaatagaa acggagatct
3661  acgcaatgga ttttcattgt actcattaaa cgagcggaaa atgaaattac tcaaattttc
3721  ttcagcgcta cacacgctca aatcatcgag gaaaaccgta tgagaaacgg atctaagctt
3781  gtcatttgat aaagcatcat gcaacattaa cccgagatac gatttgtcca tatctttgat
3841  acgacgcgc aaaagctctt cccagccga gtctacagtt atagtaatc cattgtcttt
3901  taagtattta aatactatga atatgttttt atgatgagaa cacttaaact cataattagc
3961  aagctgcctc agaatatact cagtagagtc ttcaaatatc agagctttac ctaacaacgc
4021  atactcgata tcttgcatgc gattttctat ttcggaacga gttttcatgt ttatataaaa
4081  aaataccgag cgtgctatcc tgttaacaac ctgattattt cactaatcag gacattttac
4141  ggataggtta tatcacgagg gatttcatgg gtaaagggat tttatctttg cagcaagaaa
4201  tgtcgttaga atatagcgaa aagtcttatc aggaagtttt aaaaattcgc caagaatcct
4261  attggaaacg catgaaaagc tcttgtttat tcgaagttat tatgcattgg accgcatcac
4321  tcaacaaaca tactgtaga tcatatcgag gatctttttt gtcttagaa aagattggtc
4381  tattgtcctt ggatatgaat ctgccaaga tttcccttt aatcataat ctaattctag
4441  atgcgattaa aaagttcc tctgccaaga cttcttggac cgaaggtact aaacaagttc
4501  gagcagcaag ctatattcc ttaacaagat tcctaaacag gatgactcaa ggaatagtcg
4561  ctatagcgca accttctaaa caagaaaaata gtcgaacatt ttttaaaacc agggaaatag
4621  taaaacaga tgcgatgaac agtttgcaaa cagcgtcctt cctaaaagag ctaaaaaaaa
4681  tcaatgcccg ggattggttg atcgcccaga caatgctcca aggaggtaaa cgctcctctg
4741  aagtcttaag cttggagatt agtcagatt gttccaaca agctaccatt tctttctccc
4801  agcttaagaa ccgtcagaca gaaaagagga gttccaaca ttatctcag aagtttatgc
4861  actttctaca agagtacatc ggtcaacgaa gaggtttgt cttcgtaact cgctccgaa
4921  aaatggtggg gttaaggcta atcgcccgca cgttctctca agcaggacta caagctgcaa
```

FIG. 7A (cont.)

```
4981 tcccttttaa gataacccg cacgtgcttc gagcaaccgc tgtgacggag tacaaacgcc
5041 tagggtgctc agactccgac ataatgaagg tcacaggaca cgcaaccgca aagatgatat
5101 ttgcgtacga taaatcttct cgagaagaca acgcttcaaa gaagatggct ctaatatagc
5161 ctaaagtgt tttttctggc aacagaatat gaatatatatt ttaattatat cacaatattg
5221 gggtgtttg tactagagga cttaccctctt cccagaaca ataagaacac acactttgtc
5281 tcgatgaaag acaggaaata cgcatgattt cctcatcttt taatcctatt tgcttttaaat
5341 gaatcaaagc gcttgcacga agtactctag gagtaatttt tttttcatag cactatagaa
5401 ctctgcaagc ctaaaattat gcgcaacctg acttgttgtt acaggaatcc ctattttaga
5461 aacaatact ctcccatttc tcccacaagt gtattttgc aactcctca ttaagctgat
5521 aggaaatgtg attagaatt tggtttcttt attctgtctt ttttaatgc gaaaggaaat
5581 ctgattggat gcaaaaaata gatcgtctgt gcgcaaagac aaaatttcgt ctaacttacg
5641 gatccccttgt acaatcaatt taccgattaa atagtctcta taattcacta tccggagcgc
5701 ttcaaaaaa actgtccatt cctgcttaga aatcgaata gttttgattt tgtctcggat
5761 tttaaaaaat gtagtgtttc caaaatcttt caatggacat gcgggtttaa tatatcccct
5821 ggtcaatcta tacaaaaact ttgtgaaaga tatgtagcat gccgctctag ccttgtttaga
5881 ggcctctgaa acgactttc cattaaaaac atctagagac ttgattttaa acaaagattc
5941 gctgtggtca agagaaatag ccttatcaa ggtttccgat aaatccagaa tctctaaaga
6001 aacagaaag ttaatcccag acgcataatt ttttctagtt agatgagata aagtagataa
6061 ccaaattcc gacgcgtccc caaagttaa gaacaaccta cttttatga aagccatcga
6121 gccattttc ttaaccaaag ctattcaaaa tcggagctct aagattttaa gaaattttc
6181 aacaaaagtc cattatgacc aagtctacca ccaagagttg caaagtctac caccaagagt
6241 tgcaaagtct accaccaaga gttgcaaagt ctaccaccaa gagttgcaaa tctctctcgt
6301 aaatcaaat ccctaaatat atatatata tagatatata tatgagctga cggaggatca
6361 gctcttttgc ttaaaaagtt caaaaagctg ttgtagaaga tttcgttat aggaggacaa
6421 agaaactccg gaacacatga tcgaagtat ctctattaag aaatcagata attggcgatt
6481 cttctctgaa tcagacttat ctatcgtttc tctaacgtct ttgtttctag atgaaggaag
6541 aaattgatcc aacaccctta gttcgacatt ccacatactt tccctatcac
6601 atcgaccttg gttttaaat cgccttttct agcggccaaa atatatgcgg atttataggg
```

FIG. 7A (cont.)

```
6661 gatcgattga aactctttt  gtagagtttg gttggggagg tttataaaaa gctcgtaata
6721 tgcaagagca ttgtaagcag aagacttagt tctaaaaact aactctatcc aagatgaaaa
6781 agttgttgag gagaagtgat ccttactcag gattttcta  gcattataga ttttttctcc
6841 taaaagaagt acgtgttgct tcgtatgga  tttttatctga ccagtaagca gttttaccgc
6901 taggatgtct tcttgataaa attcttcatc cgaatagttt tgggactctg ataaaaataa
6961 ttgatccaaa ctctgacttt cctcagaatt caaagttgct gagaatagtt caatggaagg
7021 aagcgtcttc ttaaaatcta agaagcgggc agtttgattt ttttaaaaa  agacattcgc
7081 ttcttttttt agtttgttca cgttgtcctc cgttaacttc agaatatctt ttcgatatgc
7141 aaaatatttg ctatttcatg cgttaacttc ctgcggccct agaatttgga
7201 tagacattag ctacagaatc ttctttaaga agagaacggc tgagagaaat atctcgacga
7261 atttgttg   aaaaaagctt gtttttgtaa atagactcga taatgtctat atacattgg
7321 ttagtcgagt tacgatcatc ccaaaaagac aaagctattc caagaatgtg ttcttcttca
7381 ggttttccga ccgaacttaa gaattcacgt atcttttgta accttagaat agaaaaaggt
7441 tctggagtta aacaagcaat taatttgtct cctgcaacaa aagcttcttt cgttaacc
```

FIG. 7B

Corresponding Amino Acid Sequence of Pgp1 (SEQ ID NO: 28):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGV_LAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSNCEITVGKNRHGSVFSSVLHFDPKISKFSAIKKVW

FIG. 7C

Corresponding Amino Acid Sequence of Pgp2 (SEQ ID NO: 29):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPENSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 7D

Corresponding Amino Acid Sequence of Pgp3 (SEQ ID NO: 30):

MGNSGFYLYNTQNCVFADNIKVGQMTEPLKDQQIILGTTSTPVAAKMTASDGISLTVSNNPSTNASITIGLDAEKAYQL
ILEKLGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVWWNA
LSNGNDILGITNTSNVSFLEVIPQTNA

FIG. 7E

Corresponding Amino Acid Sequence of Pgp4 (SEQ ID NO: 31):

MQNKSKVRDFIKIVKDVKKDFPELDKIRVNKEKVTFLNSPLELYHKSVSLILGLLQQIENSLGLFPDSPVLEKLEDN
SLKLKKALIMLILSRKDMFSKAE

FIG. 7F

Corresponding Amino Acid Sequence of Pgp5 (SEQ ID NO: 32):

GLTKEAFVAGDKLIACLTPEPFSILGLQKIREFLSSVGKPEEHILGIALSFWDDRNSTNQMYIDIIESIYKNKLFSTK
IRRDISLSRSLLKEDSVANVYPNSRAAEDILKLTHEIANILHIEYERDYSQRTT

FIG. 7G

Corresponding Amino Acid Sequence of Pgp6 (SEQ ID NO: 33):

MNKLKKEANVFFKKNQTAASLDFKKTLPSIELFSATLNSEESQSLDQLFLSESQNYSDEEFYQEDILAVKLLTGQIKSI
QKQHVLLGEKIYNARKILSKDHFSSTTFSSWIELVFRTKSSAYNALAYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 7H

Corresponding Amino Acid Sequence of Pgp7 (SEQ ID NO: 34):

MGSMAFHKSRLFLTFGDASEIWLSTLSHLTRKNYASGINFLVSLEILDLSETLIKAISLDHSESLFKIKSLDVENGKVV
SEASKQARAACYISFTKFLYRLTKGYIKPAIPLKDFGNTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFYSAMKKLLLEYFVQAL

FIG. 7I

Corresponding Amino Acid Sequence of Pgp8 (SEQ ID NO: 35):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 8A

Nucleic Acid Sequence of Plasmid NC_012625 (SEQ ID NO: 36):

```
   1 tttgcaactc ttggtggtag actttgcaac tcttggtggt agactttgca actcttggtg
  61 gtagactttg caactcttgg tgttagactt ggtcataatg gactttttgtt aaaaatttc
 121 ttaaaatctt agagctccga tttgaatag ctttggttaa gaaaatgggc tcgatggctt
 181 tccataaaag tagattgttt ttaactttg gggacgcgtc ggaaatttgg ttatctactt
 241 tatcttatct aactagaaaa aattatgcgt ctggattaa ctttcttgtt tctttagaga
 301 ttctggattt atcggaaacc ttgataaagg ctattttctct tgaccacagc gaatcttgt
 361 ttaaaatcaa gtctctagat gtttttaatg gaaaagtttgt ttcagaggca tctaaacagg
 421 ctagagcggc atgctacata tctttcacaa agtttttgta tagattgacc aagggatata
 481 ttaaaccgc tattccattg aaagattttg gaaacactac atttttttaaa atccgagaca
 541 aaatcaaaac agaatcgatt tctaagcagg aatggacagt tttttttgaa gcgctccgga
 601 tagtgaatta tagagactat ttaatcggta aattgattgt acaaggatc cgtaagttag
 661 acgaaatttt gtctttgcgc acagacgatc tattttttgc atccaatcag atttccttc
 721 gcattaaaaa aagacagaat aaagaaacca aaattctaat cacatttcct atcagcttaa
 781 tggaagagtt gcaaaaatac acttgtggga gaaatgggag agtattttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgctttgatt cattaaagc
 961 aaataggatt aaaagatgag gaaatcatgc gtattcctg tctttcatcg agacaaagtg
1021 tgtgttctta ttgttctggg gaagaggtaa ttcctctagt acaaacaccc acaatattgt
1081 gatataatta aattatatt catattctgt tgccagaaaa aacacctta ggctatatta
1141 gagccatctt ctttgaagcg ttgtcttctc gagaagattt atcgtacgca aatatcatct
1201 ttgcggttgc gtgtcctgtg accttcatta tgtcggagtc tgagcaccct agcgtttgt
1261 actccgtcac agcggttgct cgaagcacgt gcggggttat tttaaaaggg attgcagctt
1321 gtagtcctgc ttgagagaac ctgcggcga tttgccttaa ccccaccatt tttccggagc
1381 gagttacgaa gacaaaacct cttcgttgac cgatgctacg cttgtagaaag tgcataaact
1441 tctgaggata agttataata atcctctttt ctgtctgacg gttcttaagc tgggagaaag
1501 aaatggtagc ttgtttggaa caaatctgac taatctgac gcttaagact tcagaggagc
1561 gtttacctcc ttggagcatt gtctggcga tcaaccaatc ccgggcattg atttttttta
```

FIG. 8A (cont.)

```
1621 gctcttttag gaaggatgct gtttgcaaac tgttcatcgc atccgttttt actattccc
1681 tggttttaaa aaatgttcga ctattttctt gtttagaagg ttcgctata gcgactattc
1741 cttgagtcat cctgtttagg aatcttgtta aggaaatata gcttgctgct cgaacttgtt
1801 tagtaccttc ggtccaagaa gtcttggcag aggaactttt tttaatcgca tctaggatta
1861 gattatgatt taaaagggaa aactcttgca gattcatatc caaggacaat agaccaatct
1921 tttctaaaga caaaaaagat cctcgatatg atctacaagt atgttgttg agtgatgcgg
1981 tccaatgcat aataacttcg aataaggaga agcttttcat gcgttccaa taggattctt
2041 ggcgaatttt taaaacttcc tgataagact ttcactata ttctaacgac atttcttgct
2101 gcaaagataa aatccctta cccatgaaat ataacctatc cgtaaaatgt
2161 cctgattagt gaaataatca ggttgttaac gctcggtatt tttttatata
2221 aacatgaaaa ctcgttccga aatagaaaat aggatagcac gctcggtatt tgcgttgtta
2281 ggtaaagctc tgatatttga agactctact cgcatgcaag atatcgagta tgctaattat
2341 gagtttaagt gttctcatca taaaacata gagtatattc ttaatactt aaaagacaat
2401 ggattaccta taactgtaga ctcggcttgg gaagagctt tgcggcgtcg tatcaagat
2461 atgggacaaat cgtatctcgg gttaatgttg catgatgctt gtagcgctga gactttct
2521 tccgtttctc atacgttttt cctcgatgat ttgagcgtgt atccattgcg tagatctccg
2581 agtaatttca tttccgctc gtttaatgag tcaatgaaa ctgatagtg aattggagtg
2641 tttctattgc ttgagcgtat aaaggaaag ctgatagtg cacagtcaaa aattggagtg
2701 attcgcagcg ctagaggccg gtctatttat gatatatct cacagtcaga atcaaaattc tttctttgat
2761 ctggctcgta taaaaaaag acgagtagcg ttctctgaga ttatcttagc taaaggtaat
2821 ggcttcccaa caggatacaa ggatattgat gataaaggag cttagctat agacatggcg
2881 ttcgtgatta tagcagctag accatctata gggaaaacag gttgggtttcc tatctctaga aatgagcgca
2941 ataatcttg cggttactca acagcgtaga tattgctaat ttaacaggaa tatctggtga aaaattacaa
3001 ggtcaaattg ttgagcggat ttgagcggat agaatattc cgagtagaag aagctggaga ttaacttaat cgcgaatcag
3061 agagggggatc tctctaaaga tttatatctg cagtgatagt cagtatatat ttatcgatta cttgcagttg
3121 gaatcacatt tgagaaaaga agatcgagta gacgtaatat ttatcgatta cttgcagttg
3181 atccggttgc tgagaaaaga agatcgagta gacgtaatat ttatcgatta cttgcagttg
3241 atcaactcat cggttggaga aaatcgtcaa aatgaaatag cagatatatc tagaacctta
```

FIG. 8A (cont.)

```
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgttttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccacctt gaaaatcaga agtttggaag aagacctggt caatctatta
3661 agatatctcc caaattggct caaaatggga agtttgtctt tataggtctt gatttttctt
3721 catctcatta ccatgcatta gcagctatcc aaagattact gaccgcaacg aattacaagg
3781 ggaacacaaa aggggttgtt ttatccagag aatcaaatag tttttcaattt gaaggatgga
3841 taccaagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgttttttaa tagtggcaac tagaactcga tggactaatg
4021 gaacacaaat agtagaccgt taccaaactc tttctccgat cattagaatt tacgaaggat
4081 gggaaggttt aactgacgaa gaaaatatag atatagactt aacaccttttt aattcaccac
4141 ctacacggaa acataaaggg ttcgttgtag agccatgtcc tatcttggta gatcaaatag
4201 aatcctactt tgtaatcaag cctgcaaatg tataccaaga aataaaaatg cgtttcccaa
4261 atgcatcaaa gtatgcttac acatttatcg actgggtgat tacagcagct gcgaaaaaga
4321 gacgaaaatt aactaaggat aattcttggc cagaaaaactt gttattaaac gttaacgtta
4381 aaagtcttgc atatattta aggatgaatc ggtacatctg tacaaggaac tggaaaaaaa
4441 tcgagttagc tatcgataaa tgtatagaaa tcgccattca gcttggctgg ttatctagaa
4501 gaaaacgcat tgaatttctg gattcttcta aactctctaa aaaagaaatt ctatatctaa
4561 ataatagagcg ctttgaagaa ataactaaga ataactaaga acaaatggaa caagaatcta
4621 ttaattaata gcaagcttga aactaaaaac ctaatttatt aaagctcaa aataaaaaag
4681 agttttaaaa tgggaaattc tggttttttat ttgtataaca ctgaaaactg cgtcttttgct
4741 gataatatca aagttgggca aatgacagag ccgctcaagg accagcaaat aatccttggg
4801 acaacatcaa cacctgtcgc agccaaaatg acagcttctg atggatatc tttaacagtc
4861 tccaataatt catcaaccaa tgcttctatt acaattggtt tggatgcgga aaaagcttac
4921 cagcttattc tagaaaagtt gggagatcaa attcttgatg gaattgctga tactattgtt
```

FIG. 8A (cont.)

```
4981  gatagtacag  tccaagatat  tttagacaaa  atcaaaacag  acccttctct  aggtttgttg
5041  aaagcttta   acaactttcc  aatcactaat  aaaattcaat  gcaacgggtt  attcactccc
5101  agtaacattg  aaactttatt  aggaggaact  gaaataggaa  aattcacagt  cacacccaaa
5161  agctctggga  gcatgtctt   agtctcagca  gatattattg  catcaagaat  ggaaggcggc
5221  gttgtctag   cttggtacg   agaaggtgat  tctaagccct  gcgcgattag  ttatggatac
5281  tcatcaggca  ttcctaattt  atgtagtcta  agaaccagta  ttactaatac  aggattgact
5341  ccgacaacgt  attcattacg  tgtaggcggt  ttagaaagcg  gtgtgtatg   ggttaatgcc
5401  cttctaatg   gcaatgatat  tttaggaata  acaaatactt  ctaatgtatc  tttttagag
5461  gtaatacctc  aaacaaacgc  ttaaacaatt  tttattggat  tttcttata   ggttttatat
5521  ttagagaaaa  cagttcgaat  tacggggttt  gttatgcaaa  ataaaagaaa  agtgagggac
5581  gattttatta  aaattgttaa  agatgtgaaa  aaagatttcc  ccgaattaga  cctaaaaata
5641  cgagtaaaca  aggaaaaagt  aacttcta    aattctccct  tagaactcta  attcccagac
5701  gtctcactaa  ttctaggact  gcttcaacaa  atagaaaact  cttaggatt   taaaaaagc   tttgattatg
5761  tctcctgttc  ttgaaaaatt  agagataac   agttaaaagc  taaaaaagc   ctctaacgtt
5821  cttatctgt   ctagaaaaga  catgtttttcc aaggctgaat  agacaactta  ctctaacgtt
5881  ggagttgatt  tgcacacctt  agtttttgc   tctttaagg   gaggaactgg  aaaacaaca
5941  ctttctcta   acgtgggatg  caacttgcc   caattttag   ggaaaaaagt  gttacttgct
6001  gacctagacc  cgcaatccaa  tttatcttct  ggattggggg  ctagtgtcag  aagtgaccaa
6061  aaagcttgc   acgacatagt  atacacatca  aacgattta   aatcaatcat  ttgcgaaaca
6121  aaaaagata   gtgtggacct  aattcctgca  tcattttcat  ccgaacagtt  tagagaattg
6181  gatattcata  gaggacctag  taacaactta  aagttattc   tgaatgagta  ctgcgctcct
6241  ttttatgaca  tctgcataat  agacactcca  cctagcctag  gagggttaac  gaaagaagct
6301  tttgttgcag  gagacaaatt  aattgcttgt  ttaactccag  aaccttttc   tattctaggg
6361  ttacaaaaga  tacgtgaatt  cttaagttcg  gtcggaaaac  ctgaagaaga  acacattctt
6421  ggaatagctt  tgtcttttg   ggatgatcgt  aactcgacta  accaaatgta  tatagacatt
6481  atcgagtcta  tttacaaaaa  caagcttttt  tcaacaaaaa  ttcgtcgaga  tattctctc
6541  agccgttctc  ttcttaaaga  agattctgta  gctaatgtct  atccaaattc  taggccgca
6601  gaagatattc  tgaagttaac  gcatgaaata  gcaaatattt  tgcatatcga  atatgaacga
```

FIG. 8A (cont.)

```
6661 gattactctc agaggacaac gtgaacaaac taaaaaaaga agcggatgtc ttttttaaaa
6721 aaaatcaaac tgccgcttct ctagatttta agaagacgct tccctccatt gaactattct
6781 cagcaacttt gaattctgag gaaagtcaga gtttggatcg attatttta tcagagtccc
6841 aaaactattc ggatgaagaa ttttatcaag aagacatcct agcggtaaaa ctgcttactg
6901 gtcagataaa atccatacag aagcaacacg tacttctttt aggagaaaaa atctataatg
6961 ctagaaaaat cctgagtaag gatcacttct cctcaacaac ttttcatct tggatagagt
7021 tagttttag aactaagtct tctgcttaca atgctcttgc atattacgag cttttatataa
7081 acctcccaa ccaaactcta caaaaagagt ttcaatcgat cccctataaa tccgcatata
7141 tttttggccgc tagaaaaggc gatttaaaa ccaaggtcga tgtgataggg aaagtatgtg
7201 gaatgtcgaa ctcatcggcg ataagggtgt tggatcaatt tcttccttca tctagaaaca
7261 aagacgttag agaaacgata gataagtctg attcagagaa gaatcgccaa ttatctgatt
7321 tcttaataga gatacttcgc atcatgtgtt ccggagtttc tttgtcctcc tataacgaaa
7381 atcttctaca acagctttt gaacttttta agcaaaagag ctgatcctcc gtcagctcat
7441 atatatat ctattatata tatatattta gggatttgat ttcacgagag aga
```

FIG. 8B

Corresponding Amino Acid Sequence of Pgp1 (SEQ ID NO: 37):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 8C

Corresponding Amino Acid Sequence of Pgp2 (SEQ ID NO: 38):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKEFLEAYGVKRYKTSRNKYEFSGKEAETALEALYHLGHQPFLIVATRTRWTNGTQIVDRYQ
TLSPIIRIYEGWEGLFDEENIDIDLTPFNSPPTRKHKGFVVEPCPILVDQIESYFVIKPANVYQE-KMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQESIN

FIG. 8D

Corresponding Amino Acid Sequence of Pgp3 (SEQ ID NO: 39):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 8E

Corresponding Amino Acid Sequence of Pgp4 (SEQ ID NO: 40):

MQNKRKVRDDFIKIVKDKDFPELDLKIRVNKEKVTFLNSPLETYHKSVSLLIGLLQQIENSLGLFPDSPVLEKLEDN
SLKTKKALIMLILSRKDMFSKAE

FIG. 8F

Corresponding Amino Acid Sequence of Pgp5 (SEQ ID NO: 41):

MHTTVFCSFKGGTGKTTLSLNVGCNLAQFLGKKVLLADLDPQSNTSSGLGASVRSDQKGLHDIVYTSNDLKSIICETKK
DSVDLIPASFSSEQFRELDIHRGPSNNIKLFLNEYCAPFYDICIIDTPPSLGGLTKEAFVAGDKLTACTTPEPFSILGL
QKIREFLSSVGKPEEEHILGIALSFWDDRNSTNQMYIDIIESIYKNKLFSTKIRRDISLSRLLKEDSVANVYPNSRAA
EDITKLTHEIANILHIEYERDYSQRTT

FIG. 8G

Corresponding Amino Acid Sequence of Pgp6 (SEQ ID NO: 42):

MNKLKKEADVFFKKNQTAASLDFKKTLPSIELFSATLNSEESQSLDRLFLSESQNYSDEEFYQEDILAVKLLTGQIKSI QKQHVLLGEKIYNARKILSKDHFSSTTFSSWIELVFRTKSSAYNALAYYELFINLPNQTLQKEFQSIPYKSAYILAAR KGDLKTKVDVIGKVCGMSNSSAIRVLDQFLPSSRNKDVRETIDKSDSEKNRQLSDFLEILRIMCSGVSLSSYNENLLQ QLFELFKQKS

FIG. 8H

Corresponding Amino Acid Sequence of Pgp7 (SEQ ID NO: 43):

MGSMAFHKSRLFLTEGDASEIWLSTLSYLTRKNYASGINFLVSLEILDLSETLIKAISLDHSESLFKIKSLDVENGKVV SEASKQARAACYISFTKFLYRLTKGYIKPAIPLKDFGNTFFKIRDKIKTESISKQEWTVFFEALRIVNYRDYLIGKLI VQIRKLDEILSLRTDDLFFASNQISFRIKRQNKETKILTFPISLMEELQKYTCGRNGRVFVSKIGIPVTTSQVAHN FRLAEFHSAMKITPRVLRASALIHLKQIGLKDEEIMRISCLSSRQSVCSYCSGEEVIPLVQTPTIL

FIG. 8I

Corresponding Amino Acid Sequence of Pgp8 (SEQ ID NO: 44):

MGKGILSLQQEMSLEYSEKSYQEVLKIRQESYWKRMKSFSLFEVIMHWTASLNKHTCRSYRGSFLSLEKIGLLSLDMNL QEFSLLNHNLILDAIKKVSSAKTSWTEGTKQVRAASYISLTRFLNRMTQGIVAIAQPSKQENSRTFFKTREIVKTDAMN SLQTASFLKELKKINARDWLIAQTMLQGGKRSSEVLSLEISQICFQQATISFSQLKNRQTEKRIIITYPQKEMHFLQEY IGQRRGFVFVTRSGKMVGLRQIARTFSQAGLQAAIPFKITPHVLRATAVTEYKRLGCSDSDIMKVTGHATAKMIFAYDK SSREDNASKKMALI

FIG. 9A

Nucleic Acid Sequence of Plasmid NC_012626 (SEQ ID NO: 45):

```
   1 tttgcaactc ttggtggtag actttgcaac tcttggtggt agactttgca actcttggtg
  61 gtagacttgg tcataatgga ctttttgtta aaaatttctt aaaatcttag agctccgatt
 121 ttgaatagct ttggttaaga aaatggctc gatggctttc cataaagta gattgttttt
 181 aacttttggg gacgcgtcgg aaatttggtt atctacttta tcttatctaa ctagaaaaaa
 241 ttatgcgtct gggattaact ttcttgtttc tttagagatt ctgatttat cggaaacctt
 301 gataaaggct attctccttg accacagcga atctttgttt aaaatcaagt ctctagatgt
 361 ttttaatgga aaagttgttt cagaggcatc taaacaggct agagcggcat gctacatatc
 421 tttcacaaag tttttgtata gattgaccaa gggatatatt aaacccgcta ttccattgaa
 481 agattttgga aacactacat tttttaaaat ccgagacaaa atcaaaacag aatcgatttc
 541 taagcaggaa tggacagttt tttttgaagc gctccggata gtgaattata gagactattt
 601 aatcggtaaa ttgattgtac aaggatccg taagttagac gaaattttgt ctttgcgcac
 661 agacgatcta ttttttgcat ccaatcagat ttccttcgc attaaaaaaa gacagaataa
 721 agaaaccaaa attctaatca catttcctat cagcttaatg gaagagttgc aaaaatacac
 781 ttgtgggaga aatgggagag tattttgttc taaaataggg attcctgtaa caacaagtca
 841 ggttgcgcat aatttaggc ttgcagagtt ccatagtgct atgaaaataa aaattactcc
 901 cagagtactt cgtgcaagcg cttttgattca tttaaagcaa ataggattaa aagatgagga
 961 aatcatgcgt atttccgtc tttcatcgag acaaagtgtg tgttcttatt gttctgggga
1021 agaggtaatt cctctagtac aacacccac aatattgtga tataattaaa attatattca
1081 tattctgttg ccagaagatt cgtacgcaaa ctatattaga gccatcttct ttgaagcgtt
1141 gtcttctcga atgcgtgacg cgtacaccag agcccctagg gccttgtac gcggttgcgt
1201 cttcattatg tcggagtctg agcaccctag taaaagggat tgcagcttgt agtcctgctt
1261 aagcacgtgc ggggttattt caaccatttt ccggagcga gttacgaaga caaacctct
1321 gcgggcgatt tgccttaacc gtacactctt gtagaaagtg cataaacttc gttacgaata
1381 tcgttgaccg atgtactctt gtctgacggt tcttaagctg ggagaaaagaa atggtagctt
1441 cctcttttct gtctgacggt tcttaagctg tctaagctg ggagaaaaga atggtagctt
1501 aatctgacta atctccaagc ttaagacttc agaggagcgt ttacctcctt ggagcattgt
1561 ctgggcgatc aaccaatccc ggcattgat ttttttagc tcttttagga aggatgctgt
```

FIG. 9A (cont.)

```
1621 ttgcaaactg ttcatcgcat ccgttttac tatttccctg gttttaaaaa atgttcgact
1681 atttttcttgt ttagaaggtt gcgctatagc gactattcct tgagtcatcc tgtttaggaa
1741 tcttgttaag gaaatatagc ttgctgctcg aacttgttta gtaccttcgg tccaagaagt
1801 cttggcagag gaaactttt taatcgcatc taggattaga ttatgattta aagggaaaa
1861 ctcttgcaga ttcatatcca aggacaatag accaatcttt tctaaagaca aaaagatcc
1921 tcgatatgat ctacaagtat gtttgttgag tgatgcggtc caatgcataa taacttcgaa
1981 taaggagaag cttttcatgc gtttccaata ggattcttgg cgaattttta aaacttcctg
2041 ataagacttt tcactatatt ctaacgacat ttcttgctgc aaagataaaa tccctttacc
2101 catgaaatcc ctcgtgatat aacctatccg taaaatgtcc tgattagtga aataatcagg
2161 ttgttaacag gatagcacgc tcgtattttt tttatataaa catgaaaact cgttccgaaa
2221 tagaaaatcg catgcaagat atcgagtatg cgttgttagg taaagctctg atatttgaag
2281 actctactga gtatattctg aggcagcttg ctaattatga gtttaagtgt tctcatcata
2341 aaaacatatt catagtaatt aaatacttaa aagacaatgg attacctata actgtagact
2401 cggcttggga agagcttttg cggcgtcgta tcaaagatat ggacaaatcg tatctcgggt
2461 taatgttgca tgatgcttta tcaaatgaca agcttagatc cgttctcat acggttttcc
2521 tcgatgattt gagcgtgtgt agcgctgaag aaaatttgag taatttcatt ttccgctcgt
2581 ttaatgagta caatgaaaat ccattgcgta gatctccgtt tctattgctt gagcgtataa
2641 agggaaggct tgatagtgct atagcaaaga cttttctat tcgcagcgct agagccggt
2701 ctatttatga tatattctca cagtcagaaa ttggagtgct ggctcgtata aaaaaagac
2761 gagtagcgtt ctctgagaat caaaatcct tctttgatgg cttcccaaca ggatacaagg
2821 atattgatga taaggagagtt atcttagcta aaggtaattt cgtgattata gcagctagac
2881 catctatagg gaaaacagct ttagctatag acatggcgat aaatcttgcg gttactcaac
2941 agcgtagagt tggtttccta tctctagaaa tgagcgcagg tcaaattgtt gagcggatta
3001 ttgctaattt aacaggaata tctggtgaaa aattacaaag aggggatctc tctaaagaag
3061 aattaccg agtagaagaa gctagaactt aattaatcg cggttagaga atcacatttt tatatctgca
3121 gtgatagtca gtataagctt aacttaatcg cgaatcagat ccggttgctg agaaagaag
3181 atcgagtaga cgtaatattt atcgattact tgcagttgat caactcatcg gttggagaaa
3241 atcgtcaaaa tgaaatagca gatatatcta gaaccttaag aggtttagcc tcagagctaa
```

FIG. 9A (cont.)

```
3301 acattcctat agtttgttta tcccaactat ctagaaaagt tgaggataga gcaaataaag
3361 ttcccatgct ttcagatttg cgagacagcg gtcaaataga gcaagacgca gatgtgattt
3421 tgttatcaa taggaaggaa tcgtcttcta attgtgagat aactgttggg aaaaatagac
3481 atggatcggt tttctcttcg gtattacatt tcgatccaaa ccacttcatc ttctccgcta
3541 ttaaaagt atggtaaatt atagtaactg ccacttcatc aaaagtccta tccaccttga
3601 aaatcagaag tttggaagaa gacctggtca atctattaag atatctccca aattggctca
3661 aaatgggatg gtagaagtta taggtcttga tttctttca tctcattacc atgcattagc
3721 agctatccaa agattactga ccgcaacgaa ttacaagggg aacacaaaag gggttgtttt
3781 atccagagaa tcaaatagtt ttcaatttga aggatggata ccaagaatcc gttttacaaa
3841 aactgaattc ttagaggctt atggagttaa gcgtatataa acatccagaa ataagtatga
3901 gtttagtgga aaagaagctg aaactgcttt agaagcctta taccatttag gacatcaacc
3961 gttttaata gtggcaacta gaactcgatg gactaatgga acacaaatag tagaccgtta
4021 ccaaactctt tctccgatca ttaggattta cgaaggatgg gaaggtttaa ctgacgaaga
4081 aaatatagat atagacttaa cacctttaa ttcaccacct acacgaaaac ataaagggtt
4141 cgttgtagag ccatgtccta tcttggtaga tccctacttg taatcaagcc
4201 tgcaaatgta taccagaaa taaaaatgcg tttcccaaat gcatcaaagt atgcttacac
4261 atttatcgac tgggtgatta cagcagctgc gaaaattaa cgaaattaa ctaaggataa
4321 ttctttggcca gaaaacttgt tattaaacgt taacgttaaa agtcttgcat atattttaag
4381 gatgaatcgg tacatctgta caaggaactg gaaaaaaatc gagttagcta tcgataaatg
4441 tatagaaatc gccattcagc ttggctggtt atctagaaga aaacgcattg aatttctgga
4501 ttcttctaaa ctctctaaaa agaaaattct atatctaaat aaagagcgct ttgaagaaat
4561 aactaagaaa tctaagaaac aaatggaaca agaatctatt aattaatagc aagcttgaaa
4621 ctaaaaacct aatttattta aagctcaaca taaaaagag ttttaaaatg ggaaattctg
4681 gtttttattt gtataacact gaaaactgcg tctttgctga tatatcaaa gttggcaaa
4741 tgacagagcc gctcaaggac cagcaaataa tccttgggac aacatcaaca cctgtcgcag
4801 ccaaaatgac agcttctgat ggaatatctt taacagtctc caataattca tcaaccaatg
4861 cttctattac aattggtttg gatgcggaaa aagcttacca gcttattcta gaaaagttgg
4921 gagatcaaat tcttgatgga attgctgata ctattgttga tagtacagtc caagatattt
```

FIG. 9A (cont.)

```
4981 tagacaaaat caaaacagac ccttctctag gtttgttgaa agcttttaac aactttccaa
5041 tcactaataa aatcaatgc aacgggttat tcactcccag taacattgaa actttattag
5101 gaggaactga aataggaaaa ttcacagtca cacccaaaag ctctgggagc atgttcttag
5161 tctcagcaga tattattgca tcaagaatgg aaggcgcgt tgttctagct ttggtacgag
5221 aaggtgattc taagccctgc gcgattagtt atggatactc atcaggcatt cctaattat
5281 gtagtctaag accagtatt actaatacag gattgactcc gacaacgtat tcattacgtg
5341 taggcggttt agaaagcggt gtggtatggg ttaatgccct ttctaatgc aatgatattt
5401 taggaataac aaatacttct aatgtatctt tttagaggt aatacctcaa acaaacgctt
5461 aaacaatttt tattggattt ttcttatagg ttttatattt agagaaaaca gttcgaatta
5521 cggggtttgt tatgcaaaat aaaagaaaag tgaggacga ttttattaaa attgttaaag
5581 atgtgaaaaa agatttcccc gaattagacc taaaaatacg agtaaacaag gaaaaagtaa
5641 ctttcttaaa ttctccctta gaactctacc ataaaagtgt ctcactaatt ctaggactgc
5701 ttcaacaaat agaaaactct ttaggattat tccagactc tcctgttctt gaaaaattag
5761 aggataacag tttaaagcta aaaaaggctt tgattatgct tatcttgtct agaaaagaca
5821 tgtttttccaa ggctgaatag acaacttact ctaacgttgg agttgatttg cacaccttag
5881 ttttttgctc tttaaaggga ggaactggaa aaacaacact ttctctaaac gtgggatgca
5941 acttgccca atttttaggg aaaaaaagtgt tacttgctga cctagacccg caatccaatt
6001 tatcttctgg atggggct agtgtcagaa gtgaccaaaa aggcttgcac gacatagtat
6061 acacatcaaa cgattaaaa tcaatcattt gcgaaacaaa aaaagatagt gtggacctaa
6121 ttcctgcatc atttcatcc gaacagttta gagaattgga tattcataga ggacctagta
6181 acaacttaaa gttatttctg aatgagtact gcgctcctt ttatgacatc tgcataatag
6241 acactccaac tagcctagga gggttaacga aagaagcttt tgttgcagga gacaaattaa
6301 ttgctgttt aactccagaa ccttttttcta ttctaggtt acaaagata cgtgaattct
6361 taagttcggt cggaaaacct gaagaagaac acattcttgg aatagcttg tcttttttggg
6421 atgatcgtaa ctcgactaac caaatgtata tagacattat cgagtctatt tacaaaaaca
6481 agctttttc acaaaaatt cgtcgagata tttctctcag ccgttctctt cttaaagaag
6541 attctgtagc taatgtctat ccaaattcta gggccgcaga agatattctg aagttaacgc
6601 atgaaatagc aaatattttg catatcgaat atgaacgaga ttactctcag aggacaacgt
```

FIG. 9A (cont.)

```
6661 gaacaaacta aaaaaagaag cggatgtctt ttttaaaaaa aatcaaactg ccgcttctct
6721 agattttaag aagacgcttc cctccattga actattctca gcaactttga attctgagga
6781 aagtcagagt ttggatcgat tattttatc agagtcccaa aactattcgg atgaagaatt
6841 ttatcaagaa gacatcctag cggtaaaact gcttactggt cagataaaat ccatacagaa
6901 gcaacacgta cttcttttag gagaaaaaat ctataatgct agaaaaatcc tgagtaagga
6961 tcacttctcc tcaacaactt tttcatcttg gatagagtta gttttttagaa ctaagtcttc
7021 tgcttacaat gctccttgcat attacgagct ttttataaac ctccccaacc aaactctaca
7081 aaaagagttt caatcgatcc cctataaatc cgcatatatt ttggccgcta gaaaaggcga
7141 tttaaaaacc aaggtgttg tgatagggaa agtatgtgga atgtcgaact catcggcgat
7201 aagggtgttg gatcaattc ttccttcatc tagaaacaaa gacgttagag aaacgataga
7261 taagtctgat tcagagaaga atcgccaatt atctgatttc ttaatagaga tacttcgcat
7321 catgtgttcc ggagtttctt tgtcctccta aacgaaaat cttctacaac agcttttga
7381 actttttaag caaaagagct gatcctccgt cagctcatat atatatatct attatatata
7441 tatatttagg gatttgattt cacgagagag a
```

FIG. 9B

Corresponding Amino Acid Sequence of Pgp1 (SEQ ID NO: 46):

MKTRSEIENRMQDIEYALLGKALIFEDSTEYILRQLANYEFKCSHHKNIFTVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 9C

Corresponding Amino Acid Sequence of Pgp2 (SEQ ID NO: 47):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPPTRKHKGFVVEPCPILVDQIESYFVIKPANVYQEIKMRFPNASKYAYT
FIDWVITAAAKKRRKLTKDNSWPENLLINVVKSLAYILRVMNRYICTRNWKKIELAIDKCIEIAIQLGWLSRKRIEFL
DSSKLSKKEILYLNKERFEEITKKSKEQMEQESIN

FIG. 9D

Corresponding Amino Acid Sequence of Pgp3 (SEQ ID NO: 48):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 9E

Corresponding Amino Acid Sequence of Pgp4 (SEQ ID NO: 49):

MQNKRKVRDDFIKIVKDVKKDFPELDLKIRVNKEKVTFLNSPLELYHKSVSLIIGLLQQIENSLGLFPDSPVLEKLEDN
SLKLKKALIMLI-SRKDMFSKAE

FIG. 9F

Corresponding Amino Acid Sequence of Pgp5 (SEQ ID NO: 50):

MHTLVFCSFKGGTGKTTLSLNVGCNLAQFLGKKVLLADLDPQSNLSSGLGASVRSDQKGLHDIVYTSNDLKSIICETKK
DSVDLIPASFSSEQFRELDIHRGPSNNLKFLNEYCAPFYDICIIDTPPSLGGLTKEAFVAGDKLIACLTPEPFSILGL
QKIREFLSSVGKPEEHIIGIALSFWDDRNSTNQMYIDIIESIYKNKLFSTKIRRDISLSRSLLKEDSVANVYPNSRAA
EDILKLTHEIANILHIEYERDYSQRTT

FIG. 9G

Corresponding Amino Acid Sequence of Pgp6 (SEQ ID NO: 51):

VNKLKEADVFFKNQTAASLDFKKTLPSIELFSATLNSEESQSLDRLFLSESQNYSDEEFYQEDILAVKLLTGQIKSI
QKQHVLLGEKIYNARK-LSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDEKNRQLSDFLIEILRIMCSGVS-SSYNENLLQ
QLFELEKQKS

FIG. 9H

Corresponding Amino Acid Sequence of Pgp7 (SEQ ID NO: 52):

VGSMAFHKSRLFLTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 9I

Corresponding Amino Acid Sequence of Pgp8 (SEQ ID NO: 53):

VIGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQG-VAIAQPSKQENSRTFFKTREIVKTDAMN
SLQTASFLKELKKINARDWLIAQTMLQGGKRSSEVLSEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 10A

Nucleic Acid Sequence of Plasmid NC_012627 (SEQ ID NO: 54):

```
   1 tttgcaactc ttggtggtag actttgcaac tcttggttgt agactttgca actcttggtg
  61 gtagacttt g caactcttgg tgtagactt tggtcataatg gactttt gtt aaaaatttc
 121 ttaaaatctt agagctccga ttttgaatag cttggttaa gaaaatgggc tcgatggctt
 181 tccataaaag tagattgttc ttaacttttg gggacgcgtc ggaaatttgt ttatctactt
 241 tatctcatct aactagaaaa aattatgcgt ctggattaa ctttcttgtt tctttagaga
 301 ttctggattt atcggaaacc ttgataaagg ctattttctct tgaccacagc gaatctttgt
 361 ttaaaatcaa gtctctagat gtttttaatg gaaaagtcgt ttcagaggcc tctaaacagg
 421 ctagagcggc atgctacata tctttcacaa agttttttgta tagattgacc aaggatata
 481 ttaaacccgc tattccattg aaagattttg gaaacactac attttttaaa atccgagaca
 541 aaatcaaaac agaatcgatt tctaagcagg aatggacagt ttttttgaa gcgctccgga
 601 tagtgaatta tagagactat ttaatcggta aattgattgt acaaggatc cgtaagttag
 661 acgaaatttt gtcttttgcgc acagacgatc tattttttgc atccaatcag atttccttc
 721 gcattaaaaa aagacagaat aaagaaacca cacattcct atcagcttaa
 781 tggaagagtt gcaaaaatac acttgtggga gaaatgggag agtattttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttttgatt catttaaagc
 961 aaataggatt aaaagatgag gaaatcatgc gtatttcctg tctctcatcg agacaaagtg
1021 tgtgttctta ttgttctggg gaagaggtaa gtcctctagt acaaacaccc acaatattgt
1081 gatataatta aaattatatt catattctgt tgccagaaaa aacacctta ggctatatta
1141 gagccatctt cttgaagcg ttgtcttctc gagaggattt atcgtacgca aatatcatct
1201 ttgcggttgc gtgtcccgtg accttcatta tgtcggagtc tgagcaccct aggcgttttgt
1261 actccgtcac agcggttgct cgaacacgt gcggggttat cttaaaaggg attgcagctt
1321 gtagtcctgc ttgagagaac gtgcggcga tttgccttaa ccccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgtttgaaa caaatctgac taatctccaa gcttaagact tcagaggagc
1561 gtttacctcc ttggagcatt gtctgggcga tcaaccaatc ccgggcgttg atttttttta
```

FIG. 10A (cont.)

```
1621 gctcttttag gaaggatgct gtttgcaaac tgttcatcgc atccgttttt actatttccc
1681 tggttttaaa aaatgttcga ctattttctt gtttagaagg ttgcgctata gcgactattc
1741 cttgagtcat cctgtttagg aatcttgtta aggaaatata gcttgctgct cgaacttgtt
1801 tagtaccttc ggtccaagaa gtcttggcag aggaaacttt tttaatcgca tctaggatta
1861 gattatgatt taaaagggaa aactcttgca gattcatatc caaagacaat agaccaatct
1921 tttctaaaga caaaaaagat cctcgatatg atctacaagt atgttttgttg agtgatgcgg
1981 tccaatgcat aataacttcg aataaggaga agctttttcat gcgtttccaa taggattctt
2041 ggcgaatttt taaaacttcc tgataagact tttcgctata ttctaacgac atttcttgct
2101 gcaaagataa aatcccttta cccatgaaat cctcgtgat ataacctatc cgcaaaatgt
2161 cctgattagt gaaataatca ggttgttaac aggatagcac gctcggtatt ttttatata
2221 aacatgaaaa ctcgttccga aatagaaaat cgcatgcaag atatcgagta tgcgttgtta
2281 ggtaaagctc tgatatttga agactctact gagtatattc tgagcagct tgctaattat
2341 gagtttaagt gttcccatca taaaacata ttcatagtat ttaaatactt aaaagacaat
2401 ggattaccta taactgtaga ctcggcttgg gaagagcttt tgcggcgtcg tatcaaagat
2461 atggacaaat cgtatctcgg gttaatgttg catgatgctt tatcaaatga caagcttaga
2521 tccgtttctc atacggtttt cctcgatgat ttgagcgtgt gtagcgctga agaaaatttg
2581 agcaatttca tttccgctc gtttaatgag tacaatgaaa atccattgcg tagatctccg
2641 tttctattgc ttgagcgtat aaaggaaggg cttgatagtg ctatagcaaa gacttttct
2701 attcgcagcg ctagaggccg gtctatttat gatatattct cacagtcaga aattggagtg
2761 ctggctcgta taaaaaaaag acgagcagcg ttctctgaga atcaaaattc ttctttgat
2821 ggcttcccaa caggatacaa ggatattgat gataaaggag ttatcttagc taaaggtaat
2881 ttcgtgatta tagcagctag gccatctata gggaaaacag ctttagctat agacatggcg
2941 ataaatcttg cggttactca acagcgtaga gttggtttcc tatctctaga aatgagcgca
3001 ggtcaaattg ttgagcggat tattgctaat ttaacaggaa tatctggtga aaaattacaa
3061 agaggggatc tctctaaaga agaattattc cgagtagaag aagctggaga aacagttaga
3121 gaatcacatt tttatatctg cagtgatagt cagtatataagc ttaatttaat cgcgaatcag
3181 atccagttgc tgagaaaaga agatcgagta gacgtaatat ttatcgatta cttgcagttg
3241 atcaactcat cggttggaga aatcgtcaa aatgaaatag cagatatatc tagaacctta
```

FIG. 10A (cont.)

```
3301 agaggtttag cctcagagct aaacattcct atagtttgtt tatcccaact atctagaaaa
3361 gttgaggata gagcaaataa agttcccatg tttcagatt ctttcagatt cggtcaaata
3421 gagcaagacg cagatgtgat tttgtttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccacctt gaaaatcaga agtttggaag aagacctggt caatctatta
3661 agatatctcc caaattggct caaaatggga tggtagaagt tataggtctt gattttcttt
3721 catctcatta ccatgcatta gcagctatcc aaagattact gaccgcaacg aattacaagg
3781 ggaacacaaa aggggtttatt ttatccagag aatcaaatag ttttcaattt gaaggatgga
3841 taccagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgttttaa tagtgcaac tagaactcga tgactaatg
4021 gaacacaaat agtagaccgt taccaaactc tttctccgat cattaggatt tacgaaggat
4081 gggaagttt aactgacgaa gaaatatag atatagactt aacacctttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgttcccaa
4261 atgcatcaaa gtatgcttac acatttatcg actgggtgat tacagcagct gcgaaaaaga
4321 gacgaaaatt aactaaggat aattctggc cagaaaactt gttattaaac gttaacgtta
4381 aaagtcttgc atatattta aggatgaatc aggatacatcg tacaaggaac tggaaaaaaa
4441 tcgagttagc tatcgataaa tgtatagaaa tcgccattca gcttggctgg ttatctagaa
4501 gaaaacgtat tgaatttctg gattcttcta aactctctaa aaaagaaatt ctatatctaa
4561 ataaagagcg ctttgaagaa ataactaaga aatctaaaga acaaatggaa caattagaac
4621 aagaatctat taattaatag caagcttgaa actaaaaacc taatttattt aaagctcaaa
4681 ataaaaaaga gttttaaaat gggaaattct ggtttttatt tgtataacac tgaaaactgc
4741 gtctttgctg ataatatcaa agttgggcaa atgacagagc cgctcaagga ccagcaaata
4801 atccttggga caacatcaac acctgtcgca gccaaaatga cagcttctga tggaatatct
4861 ttaacagtct ccaataattc atcaaccaat gcttctatta caattggttt ggatgcggaa
4921 aaagcttacc agcttattct agaaaagttg ggagatcaaa ttcttgatgg aattgctgat
```

FIG. 10A (cont.)

```
4981 actattgttg ataatacagt ccaagatatt ttagacaaaa tcaaaacaga cccttctcta
5041 ggtttgttga aagcttttaa caactttcca atcactaata aaattcaatg caacgggtta
5101 ttcactccca gtagcattga aactttatta ggaggaactg aaataggaaa attcacagtc
5161 acacccaaaa gctctgggag catgttctta gtctcagcag atattattgc atcaagaatg
5221 gaaggcggcg ttgttctagc tttggtacga gaaggtgatt ctaagccctg cgcgattagt
5281 tatggatact catcaggcgt tcctaattta tgtagtctaa gaaccagcat tactaataca
5341 ggattgactc caacaacgta ttcattacgt gtaggcggtt tagaaagcgg tgtggtatgg
5401 gttaatgccc tttctaatgg caatgatatt ttaggaataa caaatacttc taatgtatct
5461 tttttggaag taatacctca aacaaacgct taaacaattt ttattggatt tttcttatag
5521 gttttatatt tagagaaaac agttcgaatt acggggtttg ttatgcaaaa taaaagaaaa
5581 gtgaggacg atttattaa aattgttaaa gatgtgaaaa aagatttccc cgaattagac
5641 ctaaaatac gagtaaacaa ggaaaaagta actttcttaa attctccctt agaactctac
5701 cataaaagtg tctcactaat tctaggactg cttcaacaaa tagaaaactc tttaggatta
5761 ttcccagact ctcctgttct tgaaaaatta gaggataaca gttaaagct aaaaagcct
5821 ttgattatgc ttatcttgtc tagaaaagac atgtttttcca aggctgaata gacaacttac
5881 tctaacgttg gagttgattt gcacaccttaa gtttttgct ctttaaggg aggaactgga
5941 aaaacaaacac tttctctaaa cgtgggatgc aacttggccc aattttagg gaaaaaagtg
6001 ttacttgctg acctagaccc gcaatccaat ttatctctg gattggggc tagtgtcaga
6061 agtaaccaaa aaggcttgca cgacatagta tacacatcaa acgatttaaa atcaatcatt
6121 tcgaaacaa aaaagatag tgtggacca attcctgcat catttttatc cgaacagttt
6181 agagaattgg atattcatag aggacctagt aacaacttaa agtatttct gaatgagtac
6241 tgcgctcctt tttatgacat ctgcataata gacactccac ctagcctagg agggttaacg
6301 aaagaagctt ttgttgcagg agacaaaatta attgttttgtt taactccaga accttttct
6361 attctagggt tacaaaagat acgtgaattc ttaagttcgg tcggaaaacc tgaagaagaa
6421 cacattcttg gaatagcttt gtcttttgg gatgatcgta actcgactaa ccaaatgtat
6481 atagacatta tcgagtctat ttacaaaaac aagctttttt caacaaaaat tcgtcgagat
6541 atttctctca gccgttctct tcttaaagaa gattctgtag ctaatgtcta tccaaatct
6601 aggccgcag aagatattct gaagttaacg catgaaatacg caaatatttt gcatatcgaa
```

FIG. 10A (cont.)

```
6661 tatgaacgag attactctca gaggacaacg tgaacaaact aaaaaaagaa gcggatgtct
6721 tttttaaaaa aaatcaaact gccgcttctc tagattttaa gagacactt ccttccattg
6781 aactattctc agcaactttg aattctgagg aaagtcagag tttggatcga ttatttttat
6841 cagagtccca aaactattcg gatgaagaat tttatcaaga agacatccta gcggtaaaac
6901 tgcttactgg tcagataaaa agcaacacgt atcactctc acttcttta ggagaaaaaa
6961 tctataatgc tagaagtctt ctgagtaagg atcactctc ctcaacaact tttcatctt
7021 ggatagagtt agttttttaga actaagtctt ctgcttacaa tgctcctgca tattacgagc
7081 tttttataaa cctcccaac caaactctac caaaagagtt tcaatcgatc ccctataaat
7141 ccgcatatat tttgccgct agaaaaggcg atttaaaaac caagtcgat gtgataggga
7201 aagtatgtgg aatgtcgaac tcatcggcga taagggtgtt ggatcaattt cttccttcat
7261 ctagaaacaa agacgttaga gaaacgatag ataagtctga ttcagagaag aatcgccaat
7321 tatctgattt cttaatagag atacttcgca tcatatgttc cggagtttct ttgtcctcct
7381 ataacgaaaa tcttctacaa cagcttttg aactttttaa gcaaaagagc tgatcctccg
7441 tcagctcata tatatattta ttatatat atttatttag ggattgatt ttacgagaga
7501 ga
```

FIG. 10B

Corresponding Amino Acid Sequence of Pgp1 (SEQ ID NO: 55):

MKTRSEIENRMQDIEYALIGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIQLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 10C
Corresponding Amino Acid Sequence of Pgp2 (SEQ ID NO: 56):

GLDFLSSHYHALAAIQRLLTATNYKGNTKGVILSRESNSFQFEGMIPRIRFTKTEFLEAYGVKRYKTSRNKYEFSGKEA
ETALEALYHLGHQPFLIVATRTRWTNGTQIVDRYQTLSPIIRIYEGWEGLTDEENIDIDLTPFNSPSTRKHKGFVVEPC
PILVDQIESYFVIKPANVYQEIKMRFPNASKYAYTFIDWVITAAAKKRRKLTKDNSWPENLLNVNVKSLAYILRMNRY
ICTRNWKKIELAIDKCIEIAIQLGWLSRRKRIEFLDSSKLSKKEILYLNKERFEEITKKSKEQMEQLEQESIN

FIG. 10D
Corresponding Amino Acid Sequence of Pgp3 (SEQ ID NO: 57):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 10E
Corresponding Amino Acid Sequence of Pgp4 (SEQ ID NO: 58):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 10F
Corresponding Amino Acid Sequence of Pgp5 (SEQ ID NO: 59):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKLFLNEYCAPFYDICIIDTPPSLGGLTKEAFVAGDKLIVCLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 10G

Corresponding Amino Acid Sequence of Pgp6 (SEQ ID NO: 60):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDEKNRQLSDFLIEILRIICSGVSLSSYNENLLQ
QLFELFKQKS

FIG. 10H

Corresponding Amino Acid Sequence of Pgp7 (SEQ ID NO: 61):

MGSMAFHKSRLFLTEGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 10I

Corresponding Amino Acid Sequence of Pgp8 (SEQ ID NO: 62):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 11A

Nucleic Acid Sequence of Plasmid NC_012630 (SEQ ID NO: 63):

```
   1 tttgcaactc ttggtggtag actttgcaac tcttggtggt agactttgca actcttggtg
  61 gtagactttg caactcttgg tggtagactt tggtcataatg gactttttgtt aaaaatttc
 121 ttaaaatctt agagctccga ttttgaatag ctttgtttaa gaaaatgggc tcgatgcctt
 181 tccataaaag tagattgttt ttaacttttg gggacgcgtc ggaaatttgg ttatctactt
 241 tatcttatct aactagaaaa aattatgcgt ctgggattaa ctttctgtt tctttagaga
 301 ttctggattt atcggaaacc ttgataaagg ctatttctct tgaccacagc gaatcttgt
 361 ttaaaatcaa gtctctagat gtttttaatg gaaaagttgt ttcagaggca tctaaacagg
 421 ctagagcggc atgctacata tctttcacaa agttttgta tagattgacc aagatata
 481 ttaaacccgc tattccattg aaagattttg gaaacactac atttttaaa atccgagaca
 541 aaatcaaaac agaatcgatt tctaagcagg aatgacagt tttttttgaa gcgctccgga
 601 tagtgaatta tagagactat ttaatcggta aattgattgt acaagggatc cgtttgttct
 661 ggggaagagg taattcctct agtacaaaca cccacaatat tgtgatataa ttaaaattat
 721 attcatattc tgttgccaga aaaaacacct ttatcgtata ttagagccag cttctttgaa
 781 gcgttgtctt ctcgagaaga tttatcgtac tctttgcggt tgcgtgtcct
 841 gtgaccttca ttatgtcgga gtctgagcac cctagcgtt tgtactccgt cacagcggtt
 901 gctcgaagca cgtgcgggt tattttaaaa gggattgcag cttgtagtcc tgcttgagag
 961 aacgtgcggg cgattgcct taaccccacc attttttccgg agcgagttac gaagacaaaa
1021 cctctcgtt gaccgatgta ctcttgtaga aagtgcataa acttctgagg ataagttata
1081 ataatcctct tttctgtctg acggttctta agctcttaag agctgggaga aagaaatggt agcttgttgg
1141 aaacaaatct gactaatctc caagcttaag acttcagagg agcgtttacc tccttggagc
1201 attgtctggg cgatcaacca atcccgggca ttgattttt ttactcttt taggaaggat
1261 gctgttgca aactgttcat cgcatccgtt tttactgtt tcccgtttt aaaaatgtt
1321 cgactatttt cttgtttaga aggttgcgct atagcgacta ttccttgagt catcctgttt
1381 aggaatcttg ttaaggaaat atagcttgct gctcgaactt gtttagtacc ttcggtccaa
1441 gaagtcttgg cagaggaaac tttttaatc gcatctagga ttagattatg atttaaaagg
1501 gaaaactctt gcagattcat atccaaggac aatagaccaa tcttttctaa agacaaaaa
1561 gatcctcgat atgatctaca agtatgtttg ttgagtgatg cggtccaatg cataataact
```

FIG. 11A (cont.)

```
1621  tcgataagg  agaagcttt  catgcgttc  caataggat  cttggcgaat  ttttaaact
1681  tcctgataag  actttcact  atattctaac  gacattctt  gctgcaaaga  taaaatcct
1741  ttaccatga  aatccctcgt  gatataacct  atccgtaaaa  tgtcctgat  agtgaaataa
1801  tcaggttgtt  aacaggatag  cacgctcggt  atttttttat  ataaacaggt  tgttaacagg
1861  atagcacgct  cggtatttt  ttatataaac  atgaaaactc  gttccgaaat  agaaaatcgc
1921  atgcaagata  tcgagtatgc  gttgttaggt  aaagctctga  tatttgaaga  ctctactgag
1981  tatattctga  ggcagcttgc  taattatgag  tttaagtgtt  ctcatcataa  aaacatattc
2041  atagtattta  aatacttaaa  agacaatgaa  ttacctataa  ctgtagactc  ggcttgggaa
2101  gagcttttgc  ggcgtcgtat  caaagatatg  gacaaatcgt  atctcggtt  aatgttgcat
2161  gatgcttat  caaatgacaa  gcttagatcc  gtttctcata  cggttttcct  cgatgatttg
2221  agcgtgtgta  gcgctgaaga  aaatttgagt  aattcattt  tcgctcgtt  taatgagtac
2281  aatgaaaatc  cattgcgtag  atctccgttt  ctattgcttg  agcgtataaa  gggaaggctt
2341  gatagtgcta  tagcaaagac  tttttctatt  cgcagcgcta  gaggccggtc  tatttatgat
2401  atattctcac  agtcagaaat  tggagtgctg  gctcgtataa  aaaaagacg  agtagcgttc
2461  tctgagaatc  aaaatttctt  cttgtgatgc  ttcccaacag  gatacaagga  tattgatgat
2521  aaaggagtta  tcttagctaa  aggtaattc  gtgattatag  cagctagacc  atctataggg
2581  aaaacagctt  tagctataga  catggcgata  aatcttgcgg  ttactcaaca  gcgtagagtt
2641  ggttcctat  ctctagaaat  gagcgcaggt  caaattgttg  agcggattat  tgctaattta
2701  acaggaatat  ctggtgaaaa  attacaaaga  ggggatctct  ctaaagaaga  attattccga
2761  gtagaagaag  ctggagaaac  ggttagagaa  tcacattt  atatctgcag  tgatagtcag
2821  tataagctta  acttaatcgc  gaatcagatc  cggttgctga  gaaagaaaa  tcgtcaaaat
2881  gtaatattta  tcgattactt  gcagttgatc  aactcatcgg  ttggagaaaa  tcgtcaaat
2941  gaaatagcag  atatatctag  aaccttaaga  ggttagcct  cagagctaaa  cattcctata
3001  gtttgtttat  cccaactatc  tagaaaagtt  gaggatagag  caaatagaaagt  tcccatgctt
3061  tcagatttgc  gagacagcgg  tcaaatagaa  caagacgcag  atgtgattt  gtttatcaat
3121  aggaaggaat  cgtcttctaa  ttgtgagata  actgttggga  aaaatagaca  tggatcggtt
3181  ttctcttcgg  tattacattt  cgatccaaaa  attagtaaat  tctccgctat  taaaaaagta
```

FIG. 11A (cont.)

```
3241 tgtaaatta tagtaactgc cacttcatca aaagtcctat ccaccttgaa aatcagaagt
3301 ttggaagaag acctggtcaa tctattaaga tatctcccaa attggctcaa aatggatgg
3361 tagaagttat aggtcttgat tttctttcat ctcattacca tgcattagca gctatccaaa
3421 gattactgac cgcaacgaat tacaaggggt acacaaaagg ggttgtttta tccagagaat
3481 caaatagttt tcaatttgaa ggatggatac caagaatccg ttttacaaaa actgaattct
3541 tagaggctta tggagttaag cggtatataaa catccagaaa taagtatgag tttagtggaa
3601 aagaagctga aactgcttta gaagccttat accattttagg acatcaaccg tttttaatag
3661 tggcaactag aactcgatgg actaatggaa cacaaatagt agaccgttac caactctttt
3721 ctccgatcat taggatttac gaaggatggg aaggtttaac tgacgaagaa aatatagata
3781 tagacttaac acctttttaat tcaccaccta cacggaaaca aaggggttc gttgtagagc
3841 catgtcctat cttggtagat caaatagaat cctactttgt aatcaagcct gcaaatgtat
3901 accaagaaat aaaaaatgcgt ttcccaaatg catcaaagta tgcttacaca tttatcgact
3961 gggtgattac agcagctgcg aaaagagac gaaaattaac taaggataat tcttggccag
4021 aaaacttgtt attaaacgtt aacgttaaaa gtcttgcata tattttaagg atgaatcggt
4081 acatctgtac aaggaactgc aaaaaaatcg agttagctat cgataaatgt atagaaatcg
4141 ccattaagct tggctggtta tctagaagaa aacgcattga atttctggat tcttctaaac
4201 tctctaaaaa agaaattcta tatctaaata aagagcgctt attgctgaa actaagaat
4261 ctaagaaca aatgaacaag ttagaacaag aatctattaa ttaatagcaa gcttgaaact
4321 aaaaacctaa tttattttaaa gctcaaaata aaaaagagtt ttaaaatggg aaattctggt
4381 tttttattgt ataacactga aaactgcgtc tttgctgata atatcaaagt tgggcaaatg
4441 acagagccgc tcaaggacca cttggacaa catcaacacc tgtcgcagcc
4501 aaaatgacag cttctgatgg aatatcttta acagtctcca ataattcatc aaccaatgct
4561 tctattacaa ttggttttgga tgcggaaaaa gcttaccagc gcttaccaga aagttggga
4621 gatcaaattc ttgatggaat tgctgatact attgttgata gtacagtcca agatatttta
4681 gacaaaatca aaacagaacc ttctctaggt ttgttgaaag cttttaacaa cttccaatc
4741 actaataaaa ttcaatgcaa cgggttattc actcccagta acattgaaac tttattagga
4801 ggaactgaaa taggaaaatt cacagtcaca cccaaaagct ctggggcat gttcttagtc
4861 tcagcagata ttattgcatc aagaatggaa ggcggcgttg ttctagcttt ggtacgagaa
```

FIG. 11A (cont.)

```
4921  ggtgattcta agccctgcgc gattagttat ggatactcat caggcattcc taatttatgt
4981  agtctaagaa ccagtattac taatacagga ttgactccga caacgtattc attacgtgta
5041  ggcggtttag aaagcggtgt ggtatgggtt aatgccctt ctaatggcaa tgatatttta
5101  ggaataacaa atacttctaa tgtatctttt ttagaggtaa tacctcaaac aaacgcttaa
5161  acaatttta ttggatttt cttatagtt ttatatttag agaaaacagt tcgaattacg
5221  gggtttgtta tgcaaaataa aagaaaagtg agggacgatt ttattaaaat tgttaaagat
5281  gtgaaaaaag atttcccga attagaccta aaaatacgag aaaagtgtct aaaagtaact
5341  ttcttaaatt caacaaatag actctaccat cactaattct aggactgctt
5401  caacaaatag aggattattc ctgttcttga aaaattagag
5461  gataacagtt taaagctaaa aaaggctttg ttatgtctag aaaagacatg
5521  ttttccaagg ctgaatagac aacttactct aacgttggag ttgatttgca cacctagtt
5581  ttttgctctt ttaagggagg aactggaaaa acaacacttt ctctaaacgt gggatgcaac
5641  ttggcccaat ttttagggaa aaaagtgtta cttgctgacc tagacccgca atccaattta
5701  tcttctggat tgggggctag tgtcagaagt gaccaaaaag gcttgcacga catagtatac
5761  acatcaaacg attaaaatc aatcatttgc gaaaacaaaa aagatagtgt ggacctaatt
5821  cctgcatcat tttcatccga acagtttaga gaattggata ttcatagagg acctagtaac
5881  aactttaagt tatttctgaa tgagtactgc gctcctttt atgacatctg cataatagac
5941  actccacta gcctaggagg gttaacgagg gaagcttttg ttgcaggaga caaattaatt
6001  gcttgttaa ctccagaacc tttctctatt ctaggttac aaaagatacg tgaattctta
6061  agttcgtcg gaaaacctga agaagaacac attcttggaa tagctttgtc ttttgggat
6121  gatcgtaact cgactaacca aatgtatata gacattatcg agtctattta caaaaacaag
6181  cttttcaa caaaattcg tcgagatatt tctctcagcc gttctcttct taaagaagat
6241  tctgtagcta atgtctatcc aaattctagg gccgcagaag atattctgaa gttaacgcat
6301  gaaatagcaa atattttgca tatcgaatat actctcagag gaacgagatt actctcagag gacaacgtga
6361  acaaactaaa aaaagaagcg gatgtctttt ttaaaaaaaa tcaaactgcc gcttctctag
6421  attttaagaa gacgcttccc tccattgaac tattccgaat aactttgaat tctgaggaaa
6481  gtcagagttt ggatcgatta ttttatcag agtcccaaaa ctattcggat gaagaattt
```

FIG. 11A (cont.)

```
6541 atcaagaaga catcctagcg gtaaaactgc ttactggtca gataaaatcc atacagaagc
6601 aacacgtact tctttagga gaaaaaatct ataatgctag aaaaatcctg agtaaggatc
6661 acttctcctc acaactttt tcatcttgga tagagttagt tttagaact aagtcttctg
6721 cttacaatgc tcttgcatat tacgagcttt ttataaacct cccaaccaa actctacaaa
6781 aagagtttca atcgatcccc tataaatccg catatatttt ggccgctaga aaaggcgatt
6841 taaaaccaa ggtcgatgtg atagggaaag tatgtggaat gtcgaactca tcggcgataa
6901 gggtgttgga tcaattctct cctcatcta gaaacaaaga cgttagagaa acgatagata
6961 agtctgattc agagaagaat cgccaattat ctgatttctt aatagacata cttcgcatca
7021 tgtgttccgg agtttctttg tcctcctata acgaaaaatct tctacaacag cttttttgaac
7081 tttttaagca aaagagctga tcctccgtca gctcatatat atatatctat tatatatata
7141 tatttaggga tttgatttca cgagagaga
```

FIG. 11B

Corresponding Amino Acid Sequence of Pgp1 (SEQ ID NO: 64):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIAARPSIGKFALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYFQLINSSVGENRQNEIADISRFLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 11C

Corresponding Amino Acid Sequence of Pgp2 (SEQ ID NO: 65):

MVNYSNCHF_KSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLPFNSPPTRKHGFVVEPCPILVDQIESYFVIKPANVYQEIKMRFPNASKYAYT
FIDWVITAAAKKRKLTKDNSWPENLLLNVMVKSLAYILRMNRYICTRNWKKIELAIDKCIEIAIKLGWLSRRKRIEFL
DSSKLSKKE_LYLNKERFEEITKKSKEQMEQLEQESIN

FIG. 11D

Corresponding Amino Acid Sequence of Pgp3 (SEQ ID NO: 66):

MGNSGFYLYNTENCVFADNIKVGQMTEPLKDQQIILGTTSTPVAAKMTASDGISLTVSNNSSTNASITIGLDAEKAYQL
ILEKLGDQILDGIADTVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILG_TNTSNVSFLEVIPQTNA

FIG. 11E

Corresponding Amino Acid Sequence of Pgp4 (SEQ ID NO: 67):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 11F

Corresponding Amino Acid Sequence of Pgp5 (SEQ ID NO: 68):

MHTLVFCSFKGGTGKTTLSLNVGCNLAQFLGKKVLLADLDPQSNLSSGLGASVRSDQKGLHDIVYTSNDLKSIICETKK
DSVDLIPASFSSEQFRELDIHRGPSNNLKFLNEYCAPFYD_CIIDTPPSLGGLTKEAFVAGCKLIACLTPEPFSILGL
QKIREFLSSVGKPEEHILGIALSFWDDRNSTNQMYIDIIESIYKNLFSTKIRRDISLSRSLLKEDSVANVYPNSRAA
EDILKLTHE_ANILHIEYERDYSQRTT

FIG. 11G

Corresponding Amino Acid Sequence of Pgp6 (SEQ ID NO: 69):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 11H

Corresponding Amino Acid Sequence of Pgp7 (SEQ ID NO: 70):

MGSMAFHKSRLFLTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFFKIRDKIKTESISKQEWTVFFEALRIVNYRDYLIGKLI
VQGIRCSGEEVIPLVQTPTIL

FIG. 11I

Corresponding Amino Acid Sequence of Pgp8 (SEQ ID NO: 71):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKLALI

FIG. 12A

Nucleic Acid Sequence of Plasmid NC_012631 (SEQ ID NO: 72):

```
   1 tttgcaactc ttggtggtag actttgcaac tcttggtggt agactttgca actcttggtg
  61 gtagactttg caactcttgg tggtagactt ggtcataatg gactttgtt aaaaatttc
 121 ttaaaatctt agagctccga tttgaatag ctttggttaa gaaaatgggc tcgatggctt
 181 tccataaaag tagattgttt ttaacttttg gggacgcgtc ggaaatttgg ttatctactt
 241 tatcttatct aactagaaaa aattatgcgt ctgggattaa ctttcttgtt tctttagaga
 301 ttctggattt atcggaaacc ttgataaagg ctattctct tgaccacagc gaatctttgt
 361 ttaaaatcaa gtctctagat gttttttaatg gaaaagttgt ttcagaggca tctaaacagg
 421 ctagagcggc atgctacata tcttttcacaa agtttttgta tagattgacc aagggatata
 481 ttaaacccgc tattccattg aaagattttg gaaacactac atttttttaa atccgagaca
 541 aaatcaaaac agaatcgatt tctaagcagg aatggacagt tttttttgaa gcgctccgga
 601 tagtgaatta tagagactat ttaatcggta aattgattgt acaagggatc cgtaagttag
 661 acgaaatttt gtcttttgcgc acagacgatc tattttttgc atccaatcag atttccttc
 721 gcattaaaaa aagacagaat aaagaaaacca cacattttcct atcagcttaa
 781 tggaagagtt gcaaaaatac actgtggga gaaatgggag agtatttgtt tctaaaatag
 841 ggattcctgt aacaacaagt caggttgcgc ataatttag gcttgcagag ttccatagtg
 901 ctatgaaaat aaaaattact cccagagtac ttcgtgcaag cgctttgatt catttaaagc
 961 aaataggatt aaaagatgag gaaatcatgc gtatttcctg tctttcatcg agacaaagtg
1021 tgtgttctta ttgttctggg gaagaggtaa ttccctctagt acaaacaccc acaatattgt
1081 gatataatta aaattatatt catattctgt tgccagaaaa aacaccttta ggctatatta
1141 gagccagctt ctttgaaacg ttgtcttctc gagaagattt atcgtacgca aatatcatct
1201 ttgcggttgc gtgtcctgtg accttcatta tgtcggagtc tgagcaccct aggcgttgt
1261 actccgtcac agcggttgct cgaagcacgt gcggggttat tttaaaaggg attgcagctt
1321 gtagtcctgc ttgagagaac gtgcgggcga tttgccttaa cccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgtttgaaa caaatctgac taatctccaa gcttaagact tcagaggagc
1561 gtttacctcc ttggagcatt gtctgggcga tcaaccaatc ccgggcattg atttttta
```

FIG. 12A (cont.)

```
1621  gctcttttag gaaggatgct gtttgcaaac tgttcatcgc atccgtcttt actatttccc
1681  tggttttaaa aaatgttcga ctatttcctt gtttagaagg ttgcgctata gcgactattc
1741  cttgagtcat cctgtttagg aatcttgtta aggaaatata gcttgctgct cgaacttgtt
1801  tagtaccttc ggtccaagaa gtcttggcag aggaaacttt tttaatcgca tctaggatta
1861  gattatgatt taaaagggaa aactcttgca gattcatatc caaggacaat agaccaatct
1921  tttctaaaga caaaaaagat cctcgatatg atctacaagt atgttttgttg agtgatgcgg
1981  tccaatgcat aataacttcg aataaggaga agctttcat gcgtttccaa taggattctt
2041  ggcgaatttt taaaacttcc tgataagact tttcactata ttctaacgac atttcttgct
2101  gcaaagataa aatcccttta cccatgaaat cccctcgtgat ataacctatc cgtaaaatgt
2161  cctgattagt gaattgttaac aggatagcac gctcggtatt ttttatata
2221  aacatgaaaa ctcgttccga aatagaaaat cgcatgcaag atatcgagta tgcgttgtta
2281  ggtaaagctc tgatattga agactctact gagtatattc tgaggcagct tgctaattat
2341  gagtttaagt gttctcatca taaaacata ttcatagtat ttaaatactt aaaagacaat
2401  ggattaccta taactgtaga ctcggcttgg gaagagcttt tgcggcgtcg tatcaaagat
2461  atggacaaat cgtatctcgg gttaatgttg catgatgctt tatcaaatga caagcttaga
2521  tcgttttctc atacggtttt cctcgatgat gtagcgtgt gtagcgctga agaaaatttg
2581  agtaaagctc atttccgctc gtttaatgag atccattgcg tagatctccg
2641  tttctattgc ttgagcggat aaagggaagg cttgatagtg ctatagcaaa gactttttct
2701  attcgcagcg ctagagccg gtctatttat gatatattct cacagtcaga aattggagtg
2761  ctgctcgta taaaaaaag acgagtagcg ttctctgaga atcaaaattc tttctttgat
2821  ggcttcccaa caggatacaa ggatatagat gataaggag ttatcttagc taaaggtaat
2881  ttcgtgatta tagcagctag accatcctata cttagctat agacatggcg
2941  ataaatcttg cggttactca acagcgtaga gttggtttcc tatctctaga aatgagcgca
3001  ggtcaaattg ttgagcggat tattgctaat ttaacaggaa tatctggtga aaaattacaa
3061  agagggatc tctctaaaga agaattattc cgagtagaag aagctagaag aacggttaga
3121  gaatcacatt tttatatctg cagtgatagt cagtataagc ttaacttaat cgcgaatcag
3181  atccggttgc tgagaaaaga agatcgagta gacgtaatat ttatcgatta cttgcagttg
```

FIG. 12A (cont.)

```
3241 atcaactcat cggttggaga aaatcgtcaa aatgaaatag cagatatatc tagaaccta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccaccct gaaaatcaga agtttggaag aagacctggt caatctatta
3661 agatatctcc caaattggct caaaatggga tggtagaagt tataggtctt gattttcttt
3721 catctcatta ccatgcatta gcagctatcc aaagattact gaccgcaacg aattacaagg
3781 ggaacacaaa aggggttgtt ttatccagag aatcaaatag ttttcaattt gaaggatgga
3841 taccaagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgtttttaa tagtgcaac tagaactcga tggactaatg
4021 gaacacaaat agtagaccgt taccaaactc tttctccgat cattaggatt tacgaaggat
4081 gggaaggttt aactgacgaa gaaaatatag atatagactt aacaccttt aattcaccac
4141 ctacacggaa acataaaagg ttcgtttgtag agccatgtcc tatcttggta gatcaaatag
4201 aatcctactt tgtaatcaag cctgcaaatg tataccaaga aataaaaatg cgtttcccaa
4261 atgcatcaaa gtatgcttac acatttatcg actggtgat tacagcagct gcgaaaaaga
4321 gacgaaaatt aactaaggat aattcttggc cagaaaactt gttattaaac gttaacgtta
4381 aaagtcttgc atatattta aggatgaatc ggtacatctg tacaaggaac tggaaaaaaa
4441 tcgagttagc tatcgataa tgtatagaaa tcgccattca gcttggctgg ttatctagaa
4501 gaaaacgcat tgaattctg gattcttcta aactctctaa aaaagaaatt ctatatctaa
4561 ataaagagcg ctttgaagaa ataactaaga aatctaaaga acaaatggaa caattagaac
4621 aagaatctat taattaatag caagcttgaa actaaaaacc taatttattt aagctcaaa
4681 ataaaaaaga gttttaaaat gggaaattct gtttttattt tgtataacac tgaaactgc
4741 gtctttgctg ataatatcaa agttggcaa atgacagagc cgctcaagga ccagcaaata
4801 atcctggga caacatcaac acctgtcgca gccaaaatga cagcttctga tggaatatct
4861 ttaacagtct ccaataattc atcaaccaat gctctatta caattggttt ggatgcggaa
```

FIG. 12A (cont.)

```
4921 aagcttacc agcttattct agaaaagttg ggagatcaaa ttcttgatgg aattgctgat
4981 actattgttg atagtacagt ccaagatatt ttagacaaaa tcaaaacaga cccttctcta
5041 ggtttgttga aagcttttaa caactttcca atcactaata aaattcaatg caacgggtta
5101 ttcactccca gtaacattga aacttattta ggaggaactg aaataggaaa attcacagtc
5161 acacccaaaa gctctgggag catgttctta gtctcagcag atattattgc atcaagaatg
5221 gaaggcgcg ttgttctagc tttggtacga gaaggtgatt ctaagccctg cgcgattagt
5281 tatgatact catcaggcat tcctaattta tgtagtctaa gaaccagtat tactaataca
5341 ggattgactc cgacaacgta ttcattacgt gtaggcggtt tagaaagcgg tgtggtatgg
5401 gttaatgccc tttctaatgg caatgatatt ttaggaataa caaatacttc taatgtatct
5461 tttttagagg taatacctca aacaaacgct ttattggatt ttattggatt tttcttatag
5521 gttttatatt tagagaaaac agttcgaatt acggggtttg ttatgcaaaa taaaagaaaa
5581 gtgaggacg attttattaa aatgttaaa gatgtgaaaa aagatttccc cgaattagac
5641 ctaaaaatac gagtaaacaa ggaaaaagta actttcttaa attctccctt agaactctac
5701 cataaaagtg tctcactaat tctaggactg cttcaacaaa tagaaaactc tttaggatta
5761 ttcccagact ctcctgttct tgaaaaatta gaggataaca gttaaagct aaaaaggct
5821 ttgattatgc ttatcttgtc tagaaaagac atgtttttcca aggctgaata gacaacttac
5881 tctaacgttg gagttgattt gcacaccta gttttttgct cttttaaggg aggaactgga
5941 aaaacaacac tttctctaaa cgtgggatgc aacttggccc aattttttagg gaaaaaagtg
6001 ttacttgctg acctagaccc gcaatccaat ttatcttctg gattggggc tagtgtcaga
6061 agtgaccaaa aaggcttgca cgacatagta tacacatcaa acgatttaaa atcaatcatt
6121 tgcgaaacaa aaaaagatag tgtggaccta atcctgcat cattttcatc cgaacagttt
6181 agagaattgg atattcatag aggacctagt aacaactcac agttatttct gaatgagtac
6241 tgcgctcctt tttatgacat ctgcataata gacactccac ctagcctagg agggttaacg
6301 aaagaagctt ttgttgcagg agacaaatta attgcttgtt taactccaga accttttct
6361 attctagggt tacaaaagat acgtgaattc ttaagttcgg tcggaaaacc tgaagaagaa
6421 cacattcttg gaatagcttt gtcttttttgg gatgatcgta actcgactaa ccaaatgtat
6481 atagacatta tcgagtctat ttacaaaaac aagctttttt caacaaaaat tcgtcgagat
6541 atttctctca gccgttctct tcttaaagaa gattctgtag ctaatgtcta tccaaattct
```

FIG. 12A (cont.)

```
6601  agggccgcag aagatattct gaagttaacg catgaaatag caaatatttt gcatatcgaa
6661  tatgaacgag attactctca gaggacaacg tgaacaaact aaaaaaagaa gcggatgtct
6721  tttttaaaaa aaatcaaact gccgcttctc tagatttaa gaagacgctt ccctccattg
6781  aactattctc agcaactttg aattctgagg aaagtcagag tttggatcga ttattttat
6841  cagagtccca aaactattcg gatgaagaat tttatcaaga agacatccta gcggtaaaac
6901  tgcttactgg tcagataaaa tccatacaga agcaacacgt acttcttta ggagaaaaaa
6961  tctataatgc tagaaaaatc ctgagtaagg atcacttctc ctcaacaact tttcatctt
7021  ggatagagtt agttttataa actaagtctt ctgcttacaa tgctcttgca tattacgagc
7081  tttttataaa ccctcccaac caaactctac aaaaagagtt tcaatcgatc ccctataaat
7141  ccgcatatat tttggccgct agaaaaggcg atttaaaaac caggtcgat gtgataggga
7201  aagtatgtgg aatgtcgaac tcatcggcga taaggtgtt ggatcaattt cttccttcat
7261  ctagaaacaa agacgttaga gaaacgatag atacttcgca ttcagagaag aatcgccaat
7321  tatctgattt cttaatagag tcttctacaa atacttcgca cggagtttct ttgtcctcct
7381  ataacgaaaa tcttctacaa cagctttttg aacttttaa gcaaaagagc tgatcctccg
7441  tcagctcata tatatatatc tattatatat atatattag ggatttgatt tcacgagaga
7501  ga
```

FIG. 12B

Corresponding Amino Acid Sequence of Pgp1 (SEQ ID NO: 73):

MKTRSEIENRMQDIEYALLGKALIFEDSTEYILRQLANYEFKCSHHKNIFIVFKYLKDNGLPITVDSAWEELLRRIKD
MDKSYLGIMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 12C

Corresponding Amino Acid Sequence of Pgp2 (SEQ ID NO: 74):

MVNYSNCHFIKSPIHLENQKFGRRPGQSIKISPKLAQNGMVEVIGLDFLSSHYHALAAIQRLLTATNYKGNTKGVVLSR
ESNSFQEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPPTRKHKGFVVEPCPILVDQIESYFVIKPANVYQEIKMRFPNASKYAYT
FDWVITAAKKRKLTKDNSWPENLLLNVNVKSLAYILRVNRYICTRNWKKIELAIDKCIEIAIQLGWLSRRKRIEFL
DSSKLSKKEILYLNKERFEEITKKSKEQMEQLEQESIN

FIG. 12D

Corresponding Amino Acid Sequence of Pgp3 (SEQ ID NO: 75):

MGNSGFYLYNTENCVFADNIKVGQMTEPLKDQQIILGTTSPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 12E

Corresponding Amino Acid Sequence of Pgp4 (SEQ ID NO: 76):

MQNKRKVRDDFIKIVKDVKKDFPELDLKIRVNKEKVTFLNSPLEDYHKSVSLIIGLLQQIENSLGLFPDSPVLEKLEDN
SLKIKKALIMLILSRKDMFSKAE

FIG. 12F

Corresponding Amino Acid Sequence of Pgp5 (SEQ ID NO: 77):

MHTIVFCSFKGGTGKTTLSLNVGCNLAQFLGKKVLLADLDPQSNLSSGLGASVRSDQKGLHDIVYTSNDLKSIICETKK
DSVDLIPASFSSEQFRELDIHRGPSNNLKLFLNEYCAPFYDICIIDTPPSLGGLTKEAFVAGDKLIACLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 12G

Corresponding Amino Acid Sequence of Pgp6 (SEQ ID NO: 78):

MNKLKKEADVFFKKNQTAASLDFKKTLPSIELFSATLNSEESQSLDRLFLSESQNYSDEEFYQEDILAVKLLTGQIKSI
QKQHVLLLGEKIYNARKILSKDHFSSTTFSSWIELVFRTKSSAYNALAYELFINLPNQTLQKEFQSIPYKSAYILAAR
KGDLKTKVDVIGKVCGMSNSSAIRVLDQFLPSSRNKDVRET-DKSDSEKNRQLSDFLIEILRIMCSGVSLSSYNENLLQ
QLFELFKQKS

FIG. 12H

Corresponding Amino Acid Sequence of Pgp7 (SEQ ID NO: 79):

MGSMAFHKSRLFLTFGDASEIWLSTLSYLTRKNVASGINFLVSLEIDLSETLIKAISLDHSESLFKIKSLDVFNGKVV
SEASKQARAACYISFTKFLYRLTKGYIKPAIPLKDFGNTFFKIRDKIKTESISKQEWTVFFEALRIVNYRDYLIGKLI
VQGIRKLDEILSLRTDDLFFASNQISFRIKKRQNKETKILI-FPISLMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 12I

Corresponding Amino Acid Sequence of Pgp8 (SEQ ID NO: 80):

MGKGILSLQQEMSLEYSEKSYQEVLKIRQESYWKRMKSFSLFEVIMHWTASLNKHTCRSYRGSFLSLEKIGLLSLDMNL
QEFSLLNHNLLIDAIKKVSSAKTSW-EGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKLALI

FIG. 13A

Nucleic Acid Sequence of Plasmid HE603210 (SEQ ID NO: 81):

```
   1 tttgcaactc ttggtggtag actttgcaac tcttgtggt agactttgca actcttggtg
  61 gtagactttg caactcttgg tggtagactt ggtcataatg gactttttgtt aaaaatttc
 121 ttaaaatctt agagctccga ttttgaatag ctttggttaa gaaaatgggc tcgatggctt
 181 tccataaaag tagattgttc ttaacttttg gggacgcgtc ggaaatttgg ttatctactt
 241 tatctcatct aactagaaaa aattatgcgt ctggattaa ctttcttgtt tctttagaga
 301 ttctggattt atcggaaacc ttgataaagg ctattctct tgaccacagc gaatctttgt
 361 ttaaaatcaa gtctctagat gttttttaatg gaaaagtcgt ttcagaggcc tctaaacagg
 421 ctagagcggc atgctacata tctttcacaa agttttttgta tagattgacc aaggatata
 481 ttaaacccgc tattccattg aaagattttg gaaacactac attttttaaa atccgagaca
 541 aaatcaaaac agaatcgatt tctaagcagg aatggacagt tttttttgaa gcgctccga
 601 tagtgaatta tagagactat ttaatcggta aatgattgt acaaggatc cgtaagttag
 661 acgaaatttt gtctttgcgc acagacgatc tattttttgc atccaatcag atttcctttc
 721 gcattaaaaa aagacagaat aaagaaacca aaattctaat cacatttcct atcagcttaa
 781 tggaagagtt gcaaaaatac acttgtggga gaaatgggag agtattttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttgatt catttaaagc
 961 aaataggatt aaaagatgag gaaatcatgc gtattttcctg tctctcatcg agacaaagtg
1021 tgtgttctta ttgttctggg gaagagtaa gtcctctagt acaaacaccc acaatattgt
1081 gataatta aattatatt catattctgt tgccagaaaa aggattt atcgtacgca ggctatatta
1141 gagccatctt cttgaagcg ttgtcttctc gagaggattt atcgtacgca aatatcatct
1201 ttgcggttgc gtgtcccgtg acctcatta tgtcggagtc tgagcaccct aggcgtttgt
1261 actccgtcac agcggttgct cgaagcacgt gcgggttat cttaaaaggg attgcagctt
1321 gtagtcctgc ttgagagaac gtgcgggcga tttgccttaa cccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgttggaaa caaatctgac taatctccaa gcttaagact tcagaggagc
1561 gttacctcc ttggagcatt gtctgggcga tcaaccaatc ccggcgttg atttttttta
```

FIG. 13A (cont.)

```
1621  gctctttag  gaaggatgct  gtttgcaaac  tgttcatcgc  atccgttttt  actatttccc
1681  tggttttaaa  aaatgttcga  ctattttctt  gtttagaagg  ttgcgctata  gcgactattc
1741  cttgagtcat  cctgtttagg  aatcttgtta  aggaaatata  gcttgctgct  cgaacttgtt
1801  tagtaccttc  ggtccaagaa  gtcttggcag  aggaaacttt  tttaatcgca  tctagatta
1861  gattatgatt  taaaaggaa  aactcttgca  gattcatatc  caaagacaat  agaccaatct
1921  tttctaaaga  caaaaaagat  cctcgatatg  atctacaagt  atgtttgttg  agtgatgcgg
1981  tccaatgcat  aataacttcg  aataaggaga  agcttttcat  gcgtttccaa  taggattctt
2041  ggcgaatttt  tagaaacttcc  tgataagact  tttcgctata  ttctaacgac  atttcttgct
2101  gcaaagataa  aatcccttta  cccatgaaat  cccctcgtgat  ataacctatc  cgcaaaatgt
2161  cctgattagt  gaaataatca  ggttgttaac  aggatagcac  gctcgtatt  ttttatata
2221  aacatgaaaa  ctcgttccga  aatagaaaat  cgcatgcaag  atatcgagta  tgcgttgtta
2281  ggtaaagctc  tgatatttga  agactctact  gagtatattc  tgaggcagct  tgctaattat
2341  gagtttaagt  gttcccatca  taaaaacata  ttcatagtat  ttaaatactt  aaaagacaat
2401  ggattaccta  taactgtaga  ctcggcttgg  gaagagcttt  tgcggcgtcg  tatcaaagat
2461  atggacaaat  cgtatctcgg  gttaatgttg  catgatgctt  tatcaaatga  caagcttaga
2521  tccgtttctc  atacggttt  cctcgatgat  ttgagcgtgt  gtagcgctga  agaaaattg
2581  agcaatttca  tttttccgctc  gtttaatgag  tacaatgaaa  atccattgcg  tagatctccg
2641  tttctattgc  ttgagcgtat  aaaggaagg  cttgatagtg  ctatagcaaa  gactttttct
2701  attcgcagcg  ctagaaggccg  gtctatttat  gatatattct  cacagtcaga  aattggagtg
2761  ctggctcgta  caggatacaa  acgagcagcg  ttctctgaga  atcaaaattc  tttcttgat
2821  ggcttcccaa  caggatacaa  ggatattgat  gataaggag  gggaaacag  ttatcttagc  taaagtaat
2881  ttcgtgatta  tagcagctga  gccatctata  gttggttcc  ctttagctat  agacatggcg
2941  ataaatcttg  cggttactca  acagcgtaga  ttaacaggaa  tatctggtga  aatgagcgca
3001  ggtcaaattg  ttgagcggat  tattgctaat  agaattattc  aagctggaag  aatattacaa
3061  agagggatc  tctctaaaga  agaattattc  cgagtagaag  aagctggaga  aacagttaga
3121  gaatcacatt  tttatatctg  cagtgatagt  cagtataagc  ttaatttaat  cgcgaatcag
3181  atccagttgc  tgagaaaaga  agatcgagta  gacgtaatat  ttatcgatta  cttgcagttg
```

FIG. 13A (cont.)

```
3241 atcaactcat cggttggaga aaatcgtcaa aatgaaatag cagatatatc tagaacctta
3301 agaggtttag cctcagagct aaacattcct atagtttgtt tatccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gtttttctctt cggtattaca tttcgatcca
3541 aaaattagta aattctccgc tattaaaaaa gtatggtaaa ttatagtaac tgccacttca
3601 tcaaaagtcc tatccaccttt gaaaatcaga agttttggaag aagacctgtt caatctatta
3661 agatatctcc caaattggct caaaatggga agttagaagt tatagtctt gatttctt
3721 catctcatta ccatgcatta gcagctatcc aaagattact gaccgcaacg aattacaagg
3781 ggaacacaaa agggttatt ttatccagag aatcaaatag tttctttca gaaggatgga
3841 taccaagaat ccgttttaca aaaactgaat tcttagaggc ttatggagtt aagcgtata
3901 aacatccag aatagttagtg gagtttagtg gaaaagaagc tgaaactgct ttagaagcct
3961 tataccattt aggacatccc ccgtttttaa tagtggcaac tagaactcga tggactaatg
4021 gaaacaaaat agtagaccgt taccaaactc tttctccgat cattaggatt tacgaaggat
4081 gggaagttt aactgacgaa gaaaatatag atatagactt aacacctttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgtttcccaa
4261 atgcatcaaa gtatgcttac acatttatcg actgggtgat tacagcagct gcgaaaaaga
4321 gacgaaatt aactaaggat aattcttggc cagaaaactt gttattaaac gttaacgtta
4381 aaagtcttgc atatatttta aggatgaatc ggtacatctg tacaaggaac tggaaaaaaa
4441 tcgagttagc tatcgataaa tgtatagaaa tcgccattca gcttggctgg ttatctagaa
4501 gaaaacgtat tgaattctg gattcttcta aactctctaa aaaagaaatt ctatatctaa
4561 ataaagagcg ctttgaagaa ataactaaga aatctaaaga acaaatggaa caattagaac
4621 aagaatctat taattaatag caagcttgaa actaaaaacc taatttattt aaagctcaaa
4681 ataaaaaaga gttttaaaat gggaaattct ggtttttatt tgtataacac tgaaaactgc
4741 gtctttgctg ataatatcaa agttgggcaa atgacagagc cgctcaagga ccagcaaata
4801 atccttggga caacatcaac acctgtcgca gccaaaatga gccaaaatga cagcttctga tggatatct
```

FIG. 13A (cont.)

```
4861  ttaacagtct ccaataattc atcaaccaat gcttctatta caattgttt ggatgcggaa
4921  aaagcttacc agcttattct agaaaagttg ggagatcaaa ttcttgatgg aattgctgat
4981  actattgttg ataatacagt ccaagatatt ttagacaaaa tcaaacaga cccttctcta
5041  ggtttgttga aagctttta caactttcca atcactaata aaattcaatg caacggtta
5101  ttcactccca gtagcattga aacttctatta ggaggaactg aaataggaaa attcacagtc
5161  acaccaaaa gctctgggag catgtctcta gtctcagcag atattattgc atcaagaatg
5221  gaaggcggcg ttgttctagc tttggtacga gaaggtgatt ctaagccctg cgcgattagt
5281  tatgatact catcaggcgt tcctaattta tgtagtctaa gaaccagcat tactaataca
5341  ggattgactc caacaacgta ttcattacgt gtaggcggtt tagaaagcgg tgtggtatgg
5401  gttaatgccc tttctaatgg caatgatatt ttaggaataa caaatactc taatgtatct
5461  tttttggaag taatacctca aacaaacgct taaacaattt ttattgatt ttcttatag
5521  gtttatatt tagagaaaac agttcgaatt acggggtttg ttatgcaaaa taaagaaaa
5581  gtgagggacg atttattaa gatgttgaaaa aagattccc cgaattagac
5641  ctaaaatac gagtaaacaa ggaaaagta actttcttaa attctccctt agaactctac
5701  cataaaagtg tctcactaat tctaggactg cttcaacaaa ttaggatta tttaggatta
5761  ttcccagact ctccctgttct tgaaaaatta gaggataaca gtttaaagct aaaaaggct
5821  ttgattatgc ttatctgtc tagaaaagac atgttttcca aggctgaata gacaacttac
5881  tctaacgttg gagttgattt gcacacctta gtttttgct cttttaagg aggaactgga
5941  aaaacaacac tttctctaaa cgtgggatgc aacttgccc aattttttagg gaaaaagtg
6001  ttacttgctg acctagaccc gcaatccaat ttatcttctg gattggggc tagtgtcaga
6061  agtaacttgca aggcttgca cgacatagta tacacatcaa acgattttaa atcaatcatt
6121  tgcgaaacaa aaaaagatag tgtggaccta attcctgcat cattttatc cgaacagttt
6181  agagaattgg atattcatag aggacctagt aacaacttaa agttatttct gaatgagtac
6241  tgcgctcctt ttatgacat ctgcataata gacactccac ctagcctagg agggttaacg
6301  aaagaagctt ttgttgcagg agacaaaatta attgtttgtt taactccaga accttttct
6361  attctagggt tacaaaagat acgtgaattc ttaagttcgg tcggaaaacc tgaagaagaa
6421  cacattcttg gaatagcttt gtcttttgg gatgatcgta actcgactaa ccaaatgtat
```

FIG. 13A (cont.)

```
6481 atagcatta tcgagtctat ttacaaaaac aagctttttt caacaaaaat tcgtcgagat
6541 atttctctca gccgttctct tcttaaagaa gattctgtag ctaatgtcta tccaaattct
6601 agggccgcag aagatattct gaagttaacg catgaaatag caaatatttt gcatatcgaa
6661 tatgaacgag attactctca gaggacaacg tgaacaaact aaaaaaagaa gcggatgtct
6721 tttttaaaaa aaatcaaact gccgcttctc tagattttaa gaagacactt cctccattg
6781 aactattctc agcaactttg aattctgagg aaagtcagag tttggatcga ttattttat
6841 cagagtccca aaactattcg gatgaagaat ttatcaaga agacatccta gcggtaaaac
6901 tgcttactgg tcagataaaa tccatacaga agcaacacgt acttctttta ggagaaaaaa
6961 tctataatgc tagaaaaatc ctgagtaagg atcacttctc ctcaacaact ttttcatctt
7021 ggatagagtt agttttttaga actaagtctt ctgcttacaa tgctcttgca tattacgagc
7081 tttttataaa cctcccccaac caaactctac aaaaagagtt tcaatcgatc ccctataaat
7141 ccgcatatat tttgcccgct agaaaaggcg atttaaaaac caaggtcgat gtgataggga
7201 aagtatgtgg aatgtcgaac tcatcggcga taagggtgtt ggatcaattt cttccttcat
7261 ctagaacaa agacgttaga gaaacgatag ataagtctga ataagtctga ttcagagaag aatcgcccaat
7321 tatctgattt cttaatagag atacttcgca tcatatgttc cggagtttct ttgtcctcct
7381 ataacgaaaa tcttctacaa cagctttttg aactttttaa gcaaaagagc tgatcctccg
7441 tcagctcata tatatattta ttatatat atttatttag ggatttgatt ttacgagaga
7501 ga
```

FIG. 13B

Corresponding Amino Acid Sequence of Pgp1 (SEQ ID NO: 82):

MKTRSEIENRMQDIEYALLGKALIFEDSTEYIIRQLANYEFKCSHHKNIFIVFKYLKDNGLPITVDSAWEELLRRRIKD
MDKSYLGLMLFDALSNDKLRSVSHTVFLDDLSVCSAEENLSNFIFRSFNEYNENPLRRSPFLLLERIKGRLDSAIAKTF
SIRSARGRSIYDIFSQSEIGVLARIKKRRAAFSENQNSFFDGFPTGYKDIDDKGVILAKGNFV-IAARPSIGKTALAID
MAINLAVTQQRRVGFLSLEMSAGQIVERIIANLTGISGEKLQRGDLSKEELFRVEEAGETVRESHFYICSDSQYKLNLI
ANQIQLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 13C

Corresponding Amino Acid Sequence of Pgp2 (SEQ ID NO: 83):

MVNYSNCHFIKSPIHLENQKFGRRPGQSIKISPKLAQNGMVEVIGLDFLSSHYHALAAIQRLLTATNYKGNTKGVILSR
ESNSFQFEGWIPRIRFTKTEFLEAYGVKRYKTSRNKYEFSGKEAETALEALYHLGHQPELIVATRTRWTNGTQIVDRYQ
TLSPIIRIYEGWEGLTDEENIDIDLTPENSPSTRKHKGFVVEPCPILVDQIESYFVIKPANVYQEIKMRFPNASKYAYT
FIDWVITAAAKKRRKLTKDNSWPENLLNVNVKSLAYILRMNRYICTRNWKKIELAIDKCIEIAIQLGWLSRKRIEFL
DSSKLSKKEILYLNKERFEEITKKSKEQMEQLEQESIN

FIG. 13D

Corresponding Amino Acid Sequence of Pgp3 (SEQ ID NO: 84):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVVWNA
LSNGNDILGITNTSNVSFLEVIPQTNA

FIG. 13E

Corresponding Amino Acid Sequence of Pgp4 (SEQ ID NO: 85):

MQNKRKVRDEIKIVKDVKKDFPELDLKIRVNKEKVTFLNSPLELYHKSVSLILGLLQQIENSLGLFPDSPVLEKLEDN
SLKLKKALIMLILSRKDMFSKAE

FIG. 13F

Corresponding Amino Acid Sequence of Pgp5 (SEQ ID NO: 86):

MHTLVFCSFKGGTGKTTLSLNVGCNLAQFLGKKVLLADLDPQSNLSSGLGASVRSNQKGLHDIVYTSNDLKSIICETKK
DSVDLIPASELSEQFRELDIHRGPSNNLKLFLNEYCAPFVDICIIDTPPSLGGLTKEAFVAGDKLIVCLTPEPFSILGL
QKIREFLSSVGKPEEHILGIALSFWDDRNSTNQMYIDIESIYKNKLFSTKIRRDISLSRSLLKEDSVANVYPNSRAA
EDILKLTHEIANILHIEYERDYSQRTT

FIG. 13G

Corresponding Amino Acid Sequence of Pgp6 (SEQ ID NO: 87):

MNKLKKEADVFKKNQTAASLDFKKTLPSIELFSATLNSEESQSLDRLFLSESQNYSDEEFYQEDILAVKLLTGQIKSI
QKQHVLLLGEKIYNARKILSKDHFSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDEKNRQLSDFLIEILRIICSGVSLSSYNENLLQ
QLFELFKQKS

FIG. 13H

Corresponding Amino Acid Sequence of Pgp7 (SEQ ID NO: 88):

MGSMAFHKSRLFLTFGDASEIWLSTLSHLTRKNYASGINFLVSLEILDLSETLIKAISLDHSESLFKIKSLDVENGKVV
SEASKQARAACYISFTKFLYRLTKGYIKPAIPLKDFGNTFFKIRDKIKTESISKQEWTVFFEALRIVNYRDYJIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 13I

Corresponding Amino Acid Sequence of Pgp8 (SEQ ID NO: 89):

MGKGILSLQQEMSLEYSEKSYQEVLKIRQESYWKRMKSFSLFEVIMHWTASLNKHTCRSYRGSFLSLEKIGLLSLDMNL
QEFSLLNHNJILDAIKKVSSAKTSWTEGTKQVRAASYISLTRFLNRMTQGIVAIAQPSKQENSRTFFXTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 14A

Nucleic Acid Sequence of Plasmid HE603212 (SEQ ID NO: 90):

```
   1 tttgcaactc ttggtggtag actttgcaac tcttggtggt agactttgca actcttggtg
  61 gtagactttg caactcttgg tggtagactt ggtcataatg gactttttgtt aaaaaatttc
 121 ttaaatcttt agagctccga ttttgaatag cttttggttaa gaaaatgggc tcgatggctt
 181 tccataaaag tagattgttt ttaacttttg gggacgcgtc ggaaatttgg ttatctactt
 241 tatcttatct aactagatct aattatgcgt ctgggattaa cttcttgtt tcttagaga
 301 ttctggattt atcggaaacc ttgataaagg ctattctct tgaccacagc gaatctttgt
 361 ttaaatcaa gtctctagat gttttttaatg gaaaagttgt ttcagaggca tctaaacagg
 421 ctagagcggc atgctacata tcttcacaa agttttttgta tagattgacc aaggatata
 481 ttaaacccgc tattccattg aaagattttg gaaacactac atttttttaaa atccgagaca
 541 aatcaaaaac agaatcgatt tctaagcagg aatggacagt tttttttgaa gcgctccgga
 601 tagtgaatta tagagactat ttaatcggta aatgtattgt acaaggatc cgtaagttag
 661 acgaaattt gtctttgcgc acagacgatc tattttttgc atccaatcag atttcctttc
 721 gcattaaaaa aagacagaat aaagaaacca aaattctaat cacattcct atcagcttaa
 781 tggaagagtt gcaaaaataac acttgtggga gaaatgggag agtatttgtt tctaaaatag
 841 ggattcctgt aacaacaagt caggttgcgc ataatttag gcttgcagag ttccatagtg
 901 ctatgaaaat aaaaattact cccagagtac ttcgtgcaag cgctttgatt catttaaagc
 961 aaataggatt aaaagatgag gaaatcatgc gtattcctg tcttcatcg agacaaagtg
1021 tgtgttctta ttgttctggg gaagaggtaa ttcctctagt acaaacaccc acaatattgt
1081 gatataatta aaattatatt catattctgt tgccagaaaa aacacccttta ggctatatta
1141 gagccagctt ctttgaagcg ttgtcttctc gagaagattt atcgtacgca aatatcatct
1201 ttgcggttgc gtgtcctgtg accttcattt tgtcggagtc tgagcaccct aggcgtttgt
1261 actccgtcac agcggttgct cgaagcacgt gcggggttat tttaaaaggg attgcagctt
1321 gtagtcctgc ttgagagaac gtgcgggcga tttgccttaa cccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgttggaaa caaatctgac taatctccaa gcttaagact tcagaggagc
1561 gttacctcc ttggagcatt gtctgggcga tcaaccaatc ccgggcattg atttttttta
```

FIG. 14A (cont.)

```
1621 gctcttttag gaaggatgct gtttgcaaac tgttcatcgc atccgttttt actattccc
1681 tggttttaaa aaatgttcga ctattttctt gtttagaagg tttagctata gcgactattc
1741 cttgagtcat cctgtttagg aatctgttta aggaaatata gctttgctgct cgaacttgtt
1801 tagtaccttc ggtccaagaa gtcttggcag aggaaacttt tttaatcgca tctaggatta
1861 gattatgatt aactcttgca aactcttgca caaggacaat agaccaatct
1921 tttctaaaga caaaaaagat cctcgatatg atctacaagt atgtttgttg agtgatgcgg
1981 tccaatgcat aataacttcg aataaggaga agctttcat gcgtttccaa taggattctt
2041 gcgaatttt taaaacttcc tgataagact tttcactata ttctaacgac atttcttgct
2101 gcaaagataa aatcccttta cccatgaaat cctcgtgat ataacctatc cgtaaaatgt
2161 cctgattagt gaaataatca ggttgttaac aggatagcac gctcggtatt ttttatata
2221 aacatgaaaa ctcgttccga aatagaaaat cgcatgcaag atatcgagta tgcgttgtta
2281 ggtaaagctc tgatatttga agactctact gagtatattc tgaggcagct tgctaattat
2341 gagtttaagt gttctcatca taaaacata ttcatagtat ttaaatactt aaaagacaat
2401 ggattaccta taactgtaga ctcggcttgg gaagagcttt tgcggcgtcg tatcaagat
2461 atggacaaat cgtatctcgg gttaatgttg catgatgct tatcaaatga caagcttaga
2521 tccgttttc atacggtttt cctcgatgat ttgagcgtgt gtagcgctga agaaaatttg
2581 agtaatttca tttccgctc gtttaatgag tacaatgaaa atccattgcg tagatctccg
2641 tttctattgc ttgagcgtat aaagggaagg cttgatagtg ctatagcaaa gactttttct
2701 attcgcagcg ctagaggccg gtctatttat gatatattct cacagtcaga aattggagtg
2761 ctggctcgta taaaaaaaag acgagtagcg ttcctgaga gataaaggag atcaaaattc tttctttgat
2821 ggcttcccaa caggatacaa ggatattgat gataaggag gggaaaacag cttagctat agacatggcg
2881 ttcgtgatta tagcagctag accatctata gttggtttcc tatctttagc aatgagcgca
2941 ataaatcttg cggttactca acagcgtaga ttaacaggaa tatctggtga aaaattacaa
3001 ggtcaaattg ttgagcggat tattgctaat ttaacaggaa aagctggaga aacggttaga
3061 agagggatc tctctaaaga agaattattc cgagtagaag aagctggaga aacggttaga
3121 gaatcacatt tttatatctg cagtgatagt cagtataagc ttaacttaat cgcgaatcag
3181 atccggttgc tgagaaaaga agatcgagta gacgtaatat ttatcgatta cttgcagttg
3241 atcaactcat cggttggaga aaatcgtcaa aatgaaatag cagatatatc tagaacctta
```

FIG. 14A (cont.)

```
3301 agaggtttag cctcagagct aaacattcct atagtttgtt tatccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaagtcc tatccacctt gaaaatcaga agttggaag aagacctggt caatctatta
3661 agatatctcc caaattggct caaaatggga tggtagaagt tatagtctt gatttctttt
3721 catctcatta ccatgcatta gcagctatcc aaagattact gaccgcaacg aattacaagg
3781 ggaacacaaa agggttgtt ttatccagag aatcaaatag ttttcaattt gaaggatgga
3841 taccaagaat ccgttttaca aaaactgaat tcttagaggc ttatggagtt aagcgtata
3901 aaacatccag aaataagtat gagtttagtg gaaagaaagc tgaaactgct ttagaagcct
3961 tataccattt aggacatcaa ccgttttaa tagtgcaac tagaactcga tggactaatg
4021 gaacacaaat agtagaccgt taccaaactc tttctccgat cattaggatt tacgaaggat
4081 gggaagttt aactgacgaa gaaatatag atatagactt aacacctttt aattcaccac
4141 ctacacgaa acataaaagg ttcgttgtag agccatgtcc tatcttggta gatcaaatag
4201 aatcctactt tgtaatcaag cctgcaaatg tataccaaga aataaaatg cgtttcccaa
4261 atgcatcag gtatgcttac acatttatcg actgggtgat tacagcagct gcgaaaaaga
4321 gacgaaaatt aactaaggat aattcttggc cagaaaactt gttattaaac gttaacgtta
4381 aaagtcttgc atatattta aggatgaatc ggtacatctg tacaaggaac tggaaaaaaa
4441 tcgagttagc tatcgataaa tgtatagaaa gcttggctgg ttatctagaa
4501 gaaacgcat tgaattctg gattcttcta aactctctaa aaagaaatt ctatatctaa
4561 ataagagcg ctttgaagaa ataactaaga aatctaaaga acaaatggaa caattagaac
4621 aagaatctat taattaatag caagcttgaa actaaaaacc taatttattt aaagctcaaa
4681 ataaaaaaga gttttaaaat gggaaattct gttttattt tgtataacac tgaaaactgc
4741 gtctttgctg ataatatcaa agttgggcaa agtgacagagc cgctcaagga ccagcaaata
4801 atccttggga atccgtcgca gccaaaatga gccaaaatga cagcttctga tggatgcgaa
4861 ttaacagtct ccaataattc atcaaccaat gcttctatta caattggttt ggatgcggaa
4921 aaagcttacc agcttattct ggagatcaaa ttcttgatgg aattgctgat
```

FIG. 14A (cont.)

```
4981 actattgttg atagtacagt ccaagatatt ttagacaaaa tcaaaacaga cccttctcta
5041 ggtttgttga aagctttta caactttcca atcactaata aaattcaatg caacgggtta
5101 ttcactccca gtaacattga aactttatta ggaggaactg aaataggaaa attcacagtc
5161 acacccaaaa gctctggag catgttctta gtctcagcag atattattgc atcaagaatg
5221 gaaggcggcg ttgttctagc tttggtacga gaaggtgatt ctaagccctg cgcgattagt
5281 tatggatact catcaggcat tcctaattta tgtagtctaa gaaccagtat tactaataca
5341 ggattgactc cgacaacgta ttcattacgt gtaggcggtt tagaaagcgg tgtggtatgg
5401 gttaatgccc tttctaatgg caatgatatt ttaggaataa caaatacttc taatgtatct
5461 tttttagagg taatacctca aacaaacgct taaacaattt ttattggatt tttcttatag
5521 gttttatatt tagagaaaac agttcgaatt acggggtttg ttatgcaaaa taaaagaaaa
5581 gtgagggacg attttattaa aatgttaaa gatgtgaaaa aagatttccc cgaattagac
5641 ctaaaaatac gagtaaacaa ggaaaagta actttcttaa attctcccctt agaactctac
5701 cataaaagtg tctcactaat tctaggactg cttcaacaaa tagaaaactc tttaggatta
5761 ttcccagact ctcctgttct tgaaaaatta gaggataaca gtttaaagct aaaaaagct
5821 ttgattatgc ttatcttgtc tagaaaagac atgttttcca agctgaata gacaacttac
5881 tctaacgttg gagttgattt gcacacctta gtttttttgct ctttttaaggg aggaactgga
5941 aaaaaacac tttctctaaa cgtgggatgc aacttgccc aattttttagg gaaaaaagtg
6001 ttacttgctg acctagaccc gcaatccaat ttatcttctg gattggggc tagtgtcaga
6061 agtgaccaaa aaggcttgca cgacatagta tacacatcaa acgatttaaa atcaatcatt
6121 tgcgaaacaa aaaaagatag tgtggaccta attcctgcat cattttcatc cgaacagttt
6181 agagaattgg atattcatag aggacctagt aacaacttaa agttatttct gaatgagtac
6241 tgcgctcctt tttatgacat ctgcataata gacactccac ctagcctagg agggttaacg
6301 aaagaagctt ttgttgcagg agacaaatta attgcttgtt taactccaga accttttct
6361 attctaggt tacaaagat acgtgaattc ttaagttcgg tcggaaaacc tgaagaagaa
6421 cacattcttg gaatagcttt gtcttttgg gatgatcgta actcgactaa ccaaatgtat
6481 atagacatta tcgagtctat ttacaaaaac aagctttttt caacaaaaat tcgtcgagat
6541 atttctctca gccgttctct tcttaaagaa gattctgtag ctaatgtcta tccaaattct
```

FIG. 14A (cont.)

```
6601 agggccgcag aagatattct gaagttaacg catgaaatag caaatatttt gcatatcgaa
6661 tatgaacgag attactctca gaggacaacg tgaacaaact aaaaaagaa gcggatgtct
6721 ttttaaaaa aatcaaact gccgcttctc tagattttaa gaagacgctt ccctccattg
6781 aactattctc agcaacttg aattctgagg aaagtcagag tttggatcga ttattttat
6841 cagagtccca aaactattcg gatgaagaat tttatcaaga agacatccta gcggtaaaac
6901 tgcttactgg tcagataaaa tccatacaga agcaacacgt acttctttta ggagaaaaaa
6961 tctataatgc tagaaaaatc ctgagtaagg atcacttctc ctcaacaact ttttcatctt
7021 ggatagagtt agtttttaga actaagtctt ctgcttacaa tgctcttgca tattacgagc
7081 tttttataaa cctcccccaa caaactctac aaaagagtt tcaatcgatc ccctatataat
7141 ccgcatatat tttggccgct agaaaaggcg atttaaaaac caagtcgat gtgatatggga
7201 aagtatgtgg aatgtcgaac tcatcggcga taggggtgtt ggatcaattt cttccttcat
7261 ctagaaacaa agacgttaga gaaacgatag ataagtctga ttcagagaag aatcgccaat
7321 tatctgattt cttaatagag atacttcgca tcatgtgttc cggagtttct ttgtcctcct
7381 ataacgaaa tcttctacaa cagcttttg acttttaa gcaaaagagc tgatcctccg
7441 tcagctcata tatatatatc tattatatat atatattag ggatttgatt tcacgagaga
7501 ga
```

FIG. 14B

Corresponding Amino Acid Sequence of Pgp1 (SEQ ID NO: 91):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLREDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 14C
Corresponding Amino Acid Sequence of Pgp2 (SEQ ID NO: 92):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKFLEAYGVKRYKTSRNKYEFSGKEAETALEALYHLGHQPFLIVATRTRWTNGTQ-VDRYQ
TLSPIIRIYEGWEGLTDEENIDIDLTPFNSPPTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQEQESIN

FIG. 14D
Corresponding Amino Acid Sequence of Pgp3 (SEQ ID NO: 93):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFLVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 14E
Corresponding Amino Acid Sequence of Pgp4 (SEQ ID NO: 94):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 14F
Corresponding Amino Acid Sequence of Pgp5 (SEQ ID NO: 95):

MHTLVFCSFKGGTGKTTLSLNVGCNLAQFLGKKVLLADLDPQSNLSSGLGASVRSDQKGLHDIVYTSNDLKSI-CETKK
DSVDLIPASFSSEQFRELDIHRGPSNNLKLFLNEYCAPFYDICIIDTPPSLGGLTKEAFVAGLKLIACLTPEPFSILGL
QKIREFLSSVGKPEEHLGIALSFWDDRNSTNQMYIDIIESIYKNKLFSTKIRRDISLSRSLLKEDSVANVYPNSRAA
EDILKLTHEIANLIHIEYERDYSQRTT

FIG. 14G

Corresponding Amino Acid Sequence of Pgp6 (SEQ ID NO: 96):

MNKLKKEADVFKKNQTAASLDFKKTLPSIELFSATLNSEESQSLDRLFLSESQNYSDEEFYQEDILAVKLLTGQIKSI
QKQHVLLGEKIYNARKILSKDHFSSTFSSWIELVFRTKSSAYNALAYYELFINLPNQTLQKEFQSIPYKSAYILAAR
KGDILKTKVDVIGKVCGMSNSSAIRVLDQFLPSSRNKDVRETIDKSDSEKNRQLSDFLIEILRIMCSGVSLSSYNENLLQ
QLFELFQKS

FIG. 14H

Corresponding Amino Acid Sequence of Pgp7 (SEQ ID NO: 97):

MGSMAFHKSRLFLTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKLITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 14I

Corresponding Amino Acid Sequence of Pgp8 (SEQ ID NO: 98):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKLALI

FIG. 15A

Nucleic Acid Sequence of Plasmid HE603213 (SEQ ID NO: 99):

```
   1 tttgcaactc ttggtggtag actttgcaac tcttggtggt agactttgca actcttggtg
  61 gtagactttg caactcttgg tggtagactt ggtcataatg gactttttgtt gaaaatttc
 121 ttaaaatctt agagctccga ttttgaatag ctttggttaa gaaaatgggc tcgatgcctt
 181 tccataaaag taggttgttc ttaactttg gggacgcgtc ggaaattgg ttatctactt
 241 tatctcatct aactagaaaa aattatgcgt ctggattaa ctttcttgtt tctttagaga
 301 ttctggattt atcggaaacc ttgataaagg ctattctct tgaccacagc gaatcttgt
 361 ttaaaatcaa gtctctagat gtttttaatg gaaaagtcgt ttcagaggcc tctaaacagg
 421 ctagagcggc atgctacata tctttcacaa agttttttgta tagattgacc aagggatata
 481 ttaaacccgc tattccattg aaagatttg gaaacactac atttttaaa atccgagaca
 541 aaatcaaaac agaatcgatt tctaagcagg aatggacagt tttttttgaa gcgctccgga
 601 tagtgaatta tagagactat ttaatcggta acaaggatc cgtaagttag atttccttc
 661 acgaaatttt gtcttttgcgc acagacgatc tattgattgt atccaatcag atcagcttaa
 721 gcattaaaaa aagacagaat aaagadaacca aaattctaat cacatttcct atcaaaatag
 781 tggaggagtt gcaaaaatac acttgtggga gaaatgggag agtatttgtt tctaaaatag
 841 ggattcctgt aacaacaagt caggttgcgc ataattttag gcttgcagag ttctatagtg
 901 ctatgaaaat aaaaattact cctagagtac ttcgtgcaag cgctttgatt catttaaagc
 961 aaataggatt aaaagatgag gaaatcatgc gtattccctg tctttcatcg agacaaagtg
1021 tgtgttctta ttgttctggg gaagaggtaa gtcctctagt acaaacaccc ccaatattgt
1081 gatataatta aaattatatt catattctgt tgcccagaaa gttctgagaaa ggctatatta
1141 gagccatctt ctttgaagcg ttgtctctc gagaagattt atcgtacgca aatatcatct
1201 ttgcggttgc gtgtcctgtg accttcatta tgtcggagtc cttaaaaggg aggcgttgt
1261 actccgtcac agcggttgct cgaagcacgt gcggggttat cccaccatt attgcagctt
1321 gtagtcctgc gagagaaac gtgcggcga tttgccttaa tttgtagaaag tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgttggaaa caaatctgac taatctccaa gcttaagact tcagaggagc
1561 gtttacctcc ttgagcatt gtctgggcga tcaaccaatc ccgggcattg atttttttta
```

FIG. 15A (cont.)

```
1621  gctcttttag  gaaggacgct  gtttgcaaac  tgttcatcgc  atctgttttt  actattt ccc
1681  tggttttaaa  aaatgttcga  ctatttcttt  gtttagaagg  ttcgctata  gcgactattc
1741  cttgagtcat  cctgtttagg  aatcttgtta  aggaaatata  gcttgctgct  cgaactgtt
1801  tagtacctc   ggtccaagaa  gtcttggcag  aggaaacttt  tttaatcgca  tctagaatta
1861  gattatgatt  taaaagggaa  aactcttgca  gattcatatc  caaggacaat  agaccaatct
1921  tttctaaaga  caaaaaagat  cctcgatatg  atctacaagt  atgtttgttg  agtgatgcgg
1981  tccaatgcat  aataacttcg  aataaggaga  agcttttcat  gcgttttccaa  taggattctt
2041  ggcgaatttt  taaaacttcc  tgataagact  ttcgctata   ttctaacgac  atttcttgct
2101  gcaaagataa  aatcccttta  cccatgaaat  cccctcgtgat  ataacctatc  cgtaaaatgt
2161  cctgattagt  gaaataatca  ggttgttaac  aggatagcac  gctcggtatt  tttttatata
2221  aacatgaaaa  ctcgttccga  aatagaaaat  cgcatgcaag  atatcgagta  tgcgttgtta
2281  ggtaaagctc  tgatatttga  agactctact  gagtatattc  tgaggcagct  tgctaattat
2341  gagtttaagt  gttctcatca  taaaaacata  ttcatagtat  ttaaatactt  aaaagacaat
2401  ggattaccta  taactgtaga  ctcggcttgg  gaagagcttt  tgcggcgtcg  tatcaaagat
2461  atggacaaat  cgtatctcgg  gttaatgttg  catgatgctt  tatcaaatga  caagcttaga
2521  tcgttttctc  atacggtttt  cctcgatgat  ttgagcgtgt  gtagcgctga  agaaaatttg
2581  agtaattcaa  tttccgctc   gttaatgag   atccattgcg  tagatctccg
2641  tttctattgc  ttgagcgtat  aaaggaagg   cttgacagtg  ctatagcaaa  gacttttct
2701  attcgcagcg  ctagaggccg  gtctatttat  gatatattct  cacagtcaga  aattggagtg
2761  ctggctcgta  taaaaaaaag  acgagcaacg  ttctctgaga  atcaaaattc  tttctttgat
2821  gccttcccaa  caggatacaa  ggatattgat  gataaggag   ttatcttagc  taaaggtaat
2881  ttcgtgatta  tagcagctag  gccatctata  gggaaaactg  ctttagctat  agacatggcg
2941  ataaatcttg  cggttactca  acagcgtaga  gttggtttcc  tatctctaga  aatgagcgca
3001  ggtcaaattg  ttgagcggat  tattgctaat  ttaacaggaa  tatctggtga  aaaattacaa
3061  agaggggatc  tctctaaaga  agaattattc  cgagtagaag  aagctggaga  aacagttaga
3121  gaatcacatt  tttatatctg  cagtgatagt  cagtataagc  ttaattaat   cgcgaatcag
3181  atccggtttgc tgagaaaaga  agatcgagta  gacgtaatat  ttatcgatta  cttgcagttg
```

FIG. 15A (cont.)

```
3241 atcaactcat cggtttggaga aaatcgtcaa aatgaaatag cagatatatc tagaacctta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gtttttctctt cggtattaca tttcgatcca
3541 aaaattagta aattctccgc tattaaaaaa gtatggtaaa ttatagtaac tgccacttca
3601 tcaaagtcc tatccacctt gaaaatcaga agtttggaag aagacctggt caatctatta
3661 agatatctcc caaattggct caaaatggga agttagaagt tataggtctt gattttcttt
3721 catctcatta ccatgcatta gcagctatcc aaagattgct gactgcaacg aattacaagg
3781 ggaacacaaa aggggttgtt ttatccagag aatcaaatag tttcaattt gaaggatgga
3841 taccaagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgttttttaa tagtgcaac tgagaactcga tggactaatg
4021 gaacacaaat agtagaccgt taccaaactc tttctccgat cattaggatt tacgaaggat
4081 gggaaggttt aactgacgaa gaaaatatag atatagactt aacacctttt aattcaccat
4141 ctacacggaa acataaaagg ttcgttgtag agccatgtcc tatcttggta gatcaaatag
4201 aatcctactt tgtaatcaag cctgcaaatg tataccaaga aataaaaatg cgcttcccca
4261 atgcatcaaa gtatgcttac acatttatcg actgggtgat tacagcagct gcgaaaaaga
4321 gacgaaaatt aactaaggat aattcttggc cagaaaactt gttcttaaac gttaacgtta
4381 aaagtcttgc atatattta aggatgaatc ggtacatttg tacaaggaac tggaaaaaaa
4441 tcgagttagc tatcgataaa tgtatagaaa tcgccattca gcttggttgg ttatctagaa
4501 gaaaacgcat tgaattctg gatcttcta aactctctaa aaaagaaatt ctatatctaa
4561 ataagagcg ttttgaagaa ataactaaga aatctaaaaga acaaatggaa caattagaac
4621 aagaatctat taattaatag caaacttgaa actaaaaacc taattatttt aaagctcaaa
4681 atataaaaaga gttttaaaat gggaaattct ggttttatt tgtataacac tcaaaactgc
4741 gtctttgctg ataatatcaa agttgggcaa atgacagagc cgctcaagga ccagcaaata
4801 atccttggga caacatcaac acctgtcgca gccaaaatga cagcttctga tggatatctt
4861 ttaacagtct ccaataatcc atcaaccaat gcttctatta caattggtt ggatgcggaa
```

FIG. 15A (cont.)

```
4921 aaagcttacc agcttattct agaaaagttg ggagatcaaa ttcttggtgg aattgctgat
4981 actattgttg atagtacagt ccaagatatt ttagacaaga tcacaacaga cccttctcta
5041 ggtttgttga aagcttttaa caactttcca atcactaata aaattcaatg caacgggtta
5101 ttcactccca ggaacattga aactttatta ggaggaactg aaataggaaa attcacagtc
5161 acaccaaaaa gctctgggag catgttctta gtctcagcag atattattgc atcaagaatg
5221 gaagcggcg ttgttctagc tttggtacga gaaggtgatt ctaagccta cgcgattagt
5281 tatggatact catcaggcgt tcctaattta tgtagtctaa gaaccagaat tattaataca
5341 ggattgactc cgacaacgta ttcattacgt gtaggcggtt tagaaagcgg tgtggtatgg
5401 gttaatgccc tttctaatgg caatgatatt ttaggaataa caaatacttc taatgtatct
5461 tttttggagg taatacctca aacaaacgct taaacaattt ttattgatt tttcttatag
5521 gtttatatt tagagaaaaa agttcgaatt acggggtttg ttatgcaaaa taaaagcaaa
5581 gtgagggacg attttattaa aattgttaaa gatgtgaaaa aagatttccc cgaattagac
5641 ctaaaatac gagtaaacaa ggaaaaagta acttttctaa attctccctt agaactctac
5701 cataaaagtg tctcactaat tctcaacaaa cttcaacaaa tagaaaactc tttaggatta
5761 ttcccagact ctcctgttct tgaaaaatta gaggataaca gtttaaagct aaaaaaagct
5821 ttgattatgc ttatcttgtc tagaaaagac atgtttttcca aggctgaata gataacttac
5881 tctaacgttg gagttgattt gcacacctta gttttttgct cttttaaggg aggaactgga
5941 aaaacaacac tttctctaaa cgtgggatgc aacttggccc aattttagg gaaaaaagtg
6001 ttacttgctg acctagaccc gcaatccaat ttatcttctg gattggggc tagtgtcaga
6061 agtaaccaaa aaggcttaca cgacatagta tacacatcaa acgattaaa atcaatcatt
6121 tgcgaaacaa aaaaagatag tgtggaccta attcctgcat cattttatc cgaacagttt
6181 agagaattgg atattcatag aggacctagt aacaacttaa agttatttct gaatgagtac
6241 tgcgctcctt tttatgacat ctgcataata gacactccac ctagcctagg agggttaacg
6301 aagaagctt ttgttgcagg agacaaatta attgcttgtt taactccaga accttttct
6361 attctagggt tacaaaagat acgtgaattc ttaagttcgg tcggaaaacc tgaagaagaa
6421 cacattcttg gaatagcttt gtcttttttgg gatgatcgta actcgactaa ccaatgtat
6481 atagacatta tcgagtctat ttacaaaaac aagcttttt caacaaaaat tcgtcgagat
```

FIG. 15A (cont.)

```
6541 attfctctca gccgttctct tcttaaagaa gattctgtag ctaatgtcta tccaaattct
6601 agggccgcag aagatattct gaagttaacg catgaaatag caaatatttt gcatatcgaa
6661 tatgaacgag attactctca gaggacaacg tgaacaaact aaaaaaagaa gccaatgtct
6721 tttttaaaaa aaatcaaact gccgcttctt tagatttttaa gaagacgctt ccttccattg
6781 aactattctc agcaactttg aattctgagg aaagtcagag tttgatcaa ttatttttat
6841 cagagtccca aaactattcg gatgaagaat tttatcaaga agacatccta gcgtaaaaac
6901 tgcttactgg tcagataaaa tccatacaga agcaacacgt acttcttta ggagaaaaaa
6961 tctataatgc tagaaaaatc ctgagtaagg atcactctc ctcaacaact ttttcatctt
7021 ggatagagtt agtttttaga actaagtctt ctgcttacaa tgctcttgca tattacgagc
7081 ttttttataaa cctcccaac caaactctac aaaaagagtt tcaatcgatc ccctataaat
7141 ccgcatatat tttggccgct agaaaaaggcg atttaaaaac caaggtcgat gtgataggga
7201 aagtatgtgg aatgtcgaac tcatcggcga taagggtgtt ggatcaattt cttccttcat
7261 ctagaaacaa agacgttaga gaacgatag ataagtctga ttcagagaag aatcgccaat
7321 tatctgattt cttaatagag atacttcgca tcatgtgtc cggagttct ttgtcctcct
7381 ataacgaaaa tcttctacaa cagcttttg aactttttaa gcaaaagagc tgatcctccg
7441 tcagctcata tatatatcta ttatatatat atattaggg atttgatttt acgagagaga
```

FIG. 15B

Corresponding Amino Acid Sequence of Pgp1 (SEQ ID NO: 100):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLLERIKGRLDSAIAKTF
SIRSARGRSIYDIFSQSEIGVLARIKKRRATFSENQNSFFDAFPTGYKDIDCKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 15C

Corresponding Amino Acid Sequence of Pgp2 (SEQ ID NO: 101):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLFPFNSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 15D

Corresponding Amino Acid Sequence of Pgp3 (SEQ ID NO: 102):

MGNSGFYLYNTQNCVFADNIKVGQMTEPLKDQQILGTTSTPVAAKMTASDGISLTVSNNPSTNASITIGLDAEKAYQL
ILEKLGDQILGGIADTIVDSTVQDILDKITTDPSLGLIKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVWVNA
LSNGNDILGITNTSNVSFLEVIPQTNA

FIG. 15E

Corresponding Amino Acid Sequence of Pgp4 (SEQ ID NO: 103):

MQNKSKVRDDFIKIVKDVKKDFPELDLKIRVNKEKVTFLNSPLELYHKSVSLIIGLLQQIENSLGLFPDSPVLEKLEDN
SLKLKKALIMLIISRKDMFSKAE

FIG. 15F

Corresponding Amino Acid Sequence of Pgp5 (SEQ ID NO: 104):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKFLNEYCAPFYDICIIDTPPSLGGLTKEAFVAGDKLIACLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANLIHIEYERDYSQRTT

FIG. 15G

Corresponding Amino Acid Sequence of Pgp6 (SEQ ID NO: 105):

MNKLKKEANVFFKKNQTAASLDFKKLPSIELFSATNSEESQSLDQLFLSESQNYSDEEFYQEDILAVKLLTGQIKSI
QKQHVLLLGEKIYNARKLSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDEKNRQLSDFLIEILRIMCSGVSLSSYNENLLQ
QLFELFKQKS

FIG. 15H

Corresponding Amino Acid Sequence of Pgp7 (SEQ ID NO: 106):

MGSMAFHKSRLFLTFGDASEIWLSTLSHLTRKNYASGINFLVSLEIDLSETLIKAISLDHSESLFKIKSLDVFNGKVV
SEASKQARAACYISFTKFLYRLTKGVIKPAIPLKDFGNTFFKIRDKIKTESISKQEWTVFFEALRIVNYRDYLIGKLI
VQGIRKLDELLSLRTDDLFFASNQISFRIKKRQNKETKILITFPISLMEELQKYTCGRNGRVFVSKIGIPVTTSQVAHN
FRLAEFYSAMKIKITPRVLRASALIHLKQIGLKDEEIMRISCLSSRQSVCSYCSGEEVSPLVQTPPIL

FIG. 15I

Corresponding Amino Acid Sequence of Pgp8 (SEQ ID NO: 107):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWEGTKQVRAASYISLTRFLNRMTQGIVAIAQPSKQENSRTFFKTREIVKTDAMN
SLQTASFLKELKKINARDWLIAQTMLQGGKRSSEVLSEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 16A

Nucleic Acid Sequence of Plasmid HE603218 (SEQ ID NO: 108):

```
   1  tttgcaactc ttggtggtag actttgcaac tcttggtggt agactttgca actcttggtg
  61  gtagactttg caactcttgg tggtagactt tggtcataatg gactttgtt gaaaaatttc
 121  ttaaaatctt agagctccga ttttgaatag cttggttaa gaaaatgggc tcgatgcctt
 181  tccataaaag taggttgttc ttaacttttg gggacgcgtc ggaaatttgg ttatctactt
 241  tatctcatct aactagaaaa aattatgcgt ctgggattaa cttcctgtt tctttagaga
 301  ttctggattt atcggaaacc ttgataaagg ctattcctct tgaccacagc gaatcttgt
 361  ttaaaatcaa gtctctagat gttttttaatg gaaaagtcgt ttcagaggcc tctaaacagg
 421  ctagagcggc atgctacata tctttcacaa agtttttgta tagattgacc aaggatata
 481  ttaaacccgc tattccattg aaagattttg gaaacactac attttttaaa atccgagaca
 541  aaatcaaaac agaatcgatt tctaagcagg aatggacagt ttttttgaa gcgctccgga
 601  tagtgaatta tagagactat ttaatcggta aattgattgt acaaggatc cgtaagttag
 661  acgaaatttt gtctttgcgc acagacgatc tatttttgc atccaatcag atttcctttc
 721  gcattaaaaa aagacagaat aaagaaacca aaattctaat cacattttct atcagcttaa
 781  tggaggagtt gcaaaaatac acttgtggga gaaatgggag agtattttgt tctaaaatag
 841  ggattcctgt aacaacaagt caggttgcgc ataattttag gcttgcagag ttctatagtg
 901  ctataaaaa aaaaattact cctagagtac ttcgtgcaag cgcttttgatt catttaaagc
 961  aaataggatt aaaagatgag gaaatcatgc gtattccctg tctttcatcg agacaaagtg
1021  tgtgttctta ttgttctggg gaagaggtaa gtcctctagt acaaacaccc ccaatattgt
1081  gatataatta aattatatt catattcctgt tgtcttctc gcagaagattt ggctatatta
1141  gagccatctt ctttgaagcg ttgtcttctc acccttcatta atcgtacgca aatatcatct
1201  ttgcggttgc gtgtcctgtg cgaagcacgt tgtcggagtc ctttaaaagg agcgtttgt
1261  actccgtcac agcggttgct cgaagcacgt gcggggttat cccaccatt attgcagctt
1321  gtagtcctgc ttgagagaac gtgcgggcga tttgccttaa ttgtagaaag tttccggagc
1381  gagttacgaa gacaaaacct cttcgttgac cgatgtactc ttgtagaaag tgcataaact
1441  tctgaggata agttataata atcctctttt ctgtctgacg gttcttaagc tgggagaaag
1501  aaatggtagc ttgtttggaaa caaatctgac taatctgac gcttaagact tcagaggagc
1561  gtttacctcc ttggagcatt gtctggggcga tcaaccaatc ccggcattg atttttttta
```

FIG. 16A (cont.)

```
1621 gctcttttag gaaggacgct gtttgcaaac tgttcatcgc atctgtttt actatttccc
1681 tggttttaaa aaatgttcga ctattttctt gtttagaagg ttgcgctata gcgactattc
1741 cttgagtcat cctgtttagg aatcttgtta gcttgctgct cgaacttgtt
1801 tagtaccttc ggtccaagaa gtcttggcag aggaaacttt tttaatcgca tctagaatta
1861 gattatgatt aactcttgca caaggacaat agaccaatct
1921 tttctaaaga caaaaaagat cctcgatatg atctacaagt atgtttgttg agtgatgcgg
1981 tccaatgcat aataacttcg agcttttcat gcgtttccaa taggattctt
2041 ggcgaatttt taaaacttcc tgataagact ttctaacgac atttcttgct
2101 gcaagataa atcccttta cccatgaaat ataacctatc cgtaaaatgt
2161 cctgattagt gaatatca ggttgttaac gctcggtatt ttttatata
2221 aacatgaaaa aatagaaaat atagactact atatcgagta tgcgttgtta
2281 ggtaaagctc tgatatttga agactctact tgaggcagct tgctaattat
2341 gagtttaagt gttctcatca taaaacata ttaaatactt aaaagacaat
2401 ggattaccta taactgtaga ctcggcttgg gaagagcttt tgcggcgtcg tatcaagcttaga
2461 atgaaagctt cgtatctcgg gttaatgttg catgatgctt tatcaaatga caagcttaga
2521 tccgtttctc atacggtttt cctcgatgat ttgagcgtgt gtagcgctga agaaaatttg
2581 agtaatttca ttttccgctc gtttaatgag tacaatgaaa atccattgcg tagatctccg
2641 tttctattgc ttgagcgtat aaagggaagg cttgacagtg ctatagcaaa gactttttct
2701 attcgcagcg ctagaggccg gtctatttat gatatattct cacagtcaga aattggagtg
2761 ctgctcgta taaaaaaag acgagcaacg ttctctgaga atcaaaattc tttctttgat
2821 gccttcccaa caggatacaa ggatattgat gataaggag ttatcttagc taaaggtaat
2881 ttcgtgatta tagcagctag gccatctcag gggaaaactg ctttagctat agacatggcg
2941 ataaatcttg cggttactca acagcgtaga gttggtttcc tatctctaga aatgagcgca
3001 ggtcaaattg ttgagcggat tattgctaat ttaacaggaa tatctggtga aaaattacaa
3061 agaggggatc tctctaaaga agaattattc cgagtagaag aagtagaaga aacagttaga
3121 gaatcacatt tttatatctg cagtgatagt cagtatagc ttaattaat cgcgaatcag
3181 atccggttgc tgagaaaaga agatcgagta gacgtaata ttatcgatta cttgcagttg
```

FIG. 16A (cont.)

```
3241 atcaactcat cggttggaga aaatcgtcaa aatgaaatag cagatatatc tagaacctta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aatagaaagg aatcgtcttc taattgtgag
3481 ataactgttg ggaaaaatag acatggatcg gttttctctt cggtattaca tttcgatcca
3541 aaaattagta aattctccgc tattaaaaaa gtatgtaaa ttatagtaac tgccacttca
3601 tcaaaagtcc tatccacctt gaaaatcaga agtttggaag aagacctggt caatctatta
3661 agatatctcc caaattggct caaaatggga agttagtcc tataggtctt gatttctctt
3721 catctcatta ccatgcatta gcagctatcc aaagattgct gactgcaacg aattacaagg
3781 ggaacacaaa agggttgtt ttatccagag aatcaaatag ttttcaattt gaaggatgga
3841 taccaagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgtttttaa tagtgcaac tgaaactcga tggactaatg
4021 gaacacaaat agtagaccgt taccaaactc ttttctccgat cattaggatt tacgaaggat
4081 gggaaggttt aactgacgaa gaaaatatag atatagactt aaccttcc aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgcttcccaa
4261 atgcatcaaa gtatgcttac acatttatcg actgggtgat tacagcagct gcgaaaaaga
4321 gacgaaaatt aactaaggat aattcttggc cagaaaactt gttcttaaac gttaacgtta
4381 aaagtcttgc atatattta aggatgaatc ggtacatttg tacaaggaac tggaaaaaaa
4441 tcgagttagc tatcgataaa tgtatagaaa tcgccattca gattggttgg ttatctagaa
4501 gaaaacgcat tgaatttctg gattcttcta aactctctaa aaaagaaatt ctatatctaa
4561 ataagagcg tttttgaagaa ataactaaga atctaaaaga acaaatgaa caattagaac
4621 aagaatctat taattaatag caaacttgaa actaaaaacc taatttattt aaagctcaaa
4681 ataaaaaga gtttaaaat gggaaattct gtttttatt tgtataacac tcaaaactgc
4741 gtctttgctg ataatatca agttgggcaa atgacagagc cgctcaagga ccagcaaata
4801 atccttggga caacatcaac acctgtcgca gcttctgta cagcttctga tggaatatct
4861 ttaacagtct ccaataatcc atcaaccaat gcttctatta caattggtt ggatgcggaa
```

FIG. 16A (cont.)

```
4921  aagcttacc  agcttattct  agaaaagttg  ggagatcaaa  ttcttggtgg  aattgctgat
4981  actattgttg  atagtacagt  ccaagatatt  ttagacacaga  tcacaacaga  ccctctcta
5041  ggtttgttga  aagcttttaa  caacttttcca  atcactaata  aaattcaatg  caacggttta
5101  ttcactccca  ggaacattga  aacttttatta  ggaggaactg  aatattcaatg  atcacagtc
5161  acacccaaaa  gctctgggag  catgttctta  gtctcagcag  atattattgc  atcaagaatg
5221  gaaggcggcg  ttgttctagc  tttggtacga  gaaggtgatt  ctaagccta  cgcgattagt
5281  tatgatact  catcaggcgt  tcctaattta  tgtagtctaa  gaaccagaat  tattaataca
5341  ggattgactc  cgacaacgta  ttcattacgt  gtaggcggtt  tagaaagcgg  tgtggtatgg
5401  gttaatgccc  tttctaatgg  caatgatatt  ttaggaataa  caaatacttc  taatgtatct
5461  tttttggagg  taatacctca  aacaaacgct  taaacaattt  ttattggatt  tttcttatag
5521  gttttatatt  tagagaaaaa  agttcgaatt  acggggtttg  ttatgcaaaa  taaaagcaaa
5581  gtgaggacg  attttattaa  aattgttaaa  gatgtgaaaa  aagatttccc  cgaattagac
5641  ctaaaaatac  gagtaaacaa  actttcttaa  ctttcaacaaa  attctccctt  agaactctac
5701  cataaaagtg  tctcactaat  tctaggactg  cttcaacaaa  tagaaagct  tttaggatta
5761  ttcccagact  ctcctgttct  tgaaaaatta  gaggataaca  gttaaaagct  aaaaaagct
5821  ttgattatgc  ttatcttgtc  tagaaaagac  atgttttcca  aggcgaata  gataacttac
5881  tctaacgttg  gagttgattt  gcacacctta  gttttttgct  cttttaaggg  aggaactgga
5941  aaaacaacac  tttctctaaa  cgtgggatgc  aacttggccc  aattttttagg  gaaaaagtg
6001  ttacttgctg  acctagaccc  gcaatccaat  ttatcttctg  gattggggc  tagtgtcaga
6061  agtaaccaaa  aaggcttaca  cgacatagta  tacacatcaa  acgatttaaa  atcaatcatt
6121  tgcgaaacaa  aaaaagatag  tgtggaccta  attcctgcat  catttttatc  cgaacagttt
6181  agagaattgg  atattcatag  aggacctagt  aacaacttaa  agttattttct  gaatgagtac
6241  tgcgctcctt  tttatgacat  ctgcataata  gacactccac  ctagcctagg  agggttaacg
6301  aaagaagctt  ttgttgcagg  agacaaatta  attgcttgtt  taactccaga  acctttttct
6361  attctaggggt  tacaaaagat  acgtgaattc  ttaagttcgg  tcggaaaaac  tgaagaagaa
6421  cacattcttg  gatagctttt  gtcttttttgg  gatgatcgta  actcgactaa  ccaaatgtat
6481  atagacatta  tcgagtctat  ttacaaaaac  aagcttttttt  caacaaaat  tcgtcgagat
6541  atttctctca  gccgttctct  tcttaaagaa  gattctgtag  ctaatgtcta  tccaaattct
```

FIG. 16A (cont.)

```
6601 agggccgcag aagatattct gaagttaacg catgaaatag caaatatttt gcatatcgaa
6661 tatgaacgag attactctca gaggacaacg tgaacaaact aaaaaagaa gcgaatgtct
6721 tttttaaaaa aaatcaaact gccgcttctt tagattttaa gaagacgctt cctccattg
6781 aactattctc agcaactttg aattctgagg aaagtcagag tttggatcaa ttatttttat
6841 cagagtccca aaactattcg gatgaagaat tttatcaaga agacatccta gcggtaaaac
6901 tgcttactgg tcagataaaa tccatacaga agcaacacgt acttcttta ggagaaaaaa
6961 tctataatgc tagaaaaatc ctgagtaagg atcactctc ctcaacaact tttcatctt
7021 ggatagagtt agttttaga actaagtctt ctgcttacaa tgctcttgca tattacgagc
7081 tttttataaa cctcccaac caaactctac aaaagagtt tcaatcgatc ccctatataat
7141 ccgcatatat tttggccgct agaaaaggcg atttaaaaac caaggtcgat gtgataggga
7201 aagtatgtgg aatgtcgaac tcatcggcga taagggtgtt ggatcaattt cttccttcat
7261 ctagaaacaa agacgttaga gaaacgatag atacttcgca ttcagagaag aatcgccaat
7321 tatctgattt cttaatagag atactttcca tcatgtgttc cggagttct ttgtcctcct
7381 ataacgaaaa tcttctacaa cagcttttg aacttttaa gcaaaagagc tgatcctccg
7441 tcagctcata tatatatcta ttatatatat atatttaggg atttgatttt acgagagaga
```

FIG. 16B

Corresponding Amino Acid Sequence of Pgp1 (SEQ ID NO: 109):

MKTRSEIENRMQDIEYALLGKALIFEDSTEYILRQLANYEFKCSHHKNIFIVFKYLKDNGLPITVDSAWEELLRRRIKD
MDKSYLGIMLHDALSNDKIRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEI=VGKNRHGSVFSSVLHFDPKISKFSAIKKVW

FIG. 16C

Corresponding Amino Acid Sequence of Pgp2 (SEQ ID NO: 110):

MVNYSNCHFRKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIRIYEGWEGLTDEENIDIDLTPFNSPSTRKHGFVVEPCPILVDQIESYFVIKPANVYQEIKMRFPNASKYAYT
FRDWITAAAKKRKLTKDNSWPENLFLNVVVKSLAYILRMNRYICTRNWKKIELAIDKCIEIAIQIGWLSRRKRIEFL
DSSKRSKKERLYRNKERFEEITKKSKEQMEQLEQESIN

FIG. 16D

Corresponding Amino Acid Sequence of Pgp3 (SEQ ID NO: 111):

MGNSGFYLYNTQNCVFADNIKVGQMTEPLKDQQIILGTTSTPVAAKMTASDGISLTVSNNPSTNASITIGLDAEKAYQL
ILEKRGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVVWVNA
LSNGNDILGRTNTSNVSFLEVIPQTNA

FIG. 16E

Corresponding Amino Acid Sequence of Pgp4 (SEQ ID NO: 112):

MQNKSKVRDDFIKIVKDVKKDFPELDLKIRVNKEKVTFLNSPLELYHKSVSLILGLLQQIENSLGLFPDSPVLEKLEDN
SLKLKKALIMLIRSRKDMFSKAE

FIG. 16F

Corresponding Amino Acid Sequence of Pgp5 (SEQ ID NO: 113):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKLFLNEYCAPFYDICIIDTPPSLGLTKEAFVAGRKLIACLTPEPFSILGL
QKIRFLSSVGKPEEHLLGIALSFWDDRNSTNQMYIDIIESIYKNLFSTKIRRDISLSRSLLKEDSVANVYPNSRAA
EDILKLTHERANILHIEYERDYSQRTT

FIG. 16G

Corresponding Amino Acid Sequence of Pgp6 (SEQ ID NO: 114):

MNKLKKEANVFFKKNQTAASLDFKKTLPSIELFSATLNSEESQSLDQLFLSESQNYSDEEFYQEDILAVKLLTGQIKSI
QKQHVLLLGEKIYNARKILSKDHFSSTTFSSWIELVERTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 16H

Corresponding Amino Acid Sequence of Pgp7 (SEQ ID NO: 115):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFYSAMKKKITPRVLRASALIHLKQIGLKDEEIMRISCLSSRQSVCSYCSGEEVSPLVQTPPIL

FIG. 16I

Corresponding Amino Acid Sequence of Pgp8 (SEQ ID NO: 116):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 17A

Nucleic Acid Sequence of Plasmid HE603227 (SEQ ID NO: 117):

```
   1 aactcttggt ggtagactt gcaactcttg gtggtagact ttgcaactct tggtggtaga
  61 cttggtcata atggactttt gttgaaaaat ttcttaaaat cttagagctc cgatttgaa
 121 tagctttggt taagaaaatg ggctcgatgg cttccataa aagtaggttg ttcttaactt
 181 ttggggacgc gtcggaaatt tggttatcta ctttatctca tctaactaga aaaaattatg
 241 cgtctgggat taacttctct gttctttag agattctgga tttatcggaa accttgataa
 301 aggctatttc tcttgaccac agcgaatctt tgtttaaaat caagtctcta gatgttttta
 361 atgaaaagt cgtttcagag gcctctaaac aggctagagc ggcatgctac atatctttca
 421 caaagttttt gtatagattg accaagggat atattaaacc cgctattcca ttgaaagatt
 481 ttgaaacac tacattttt aaaatccgag acaaaatcaa aacagaatcg atttctaagc
 541 aggaatggac agttttttt gaagcgctcc ggatagtgaa ttataagac tatttaatcg
 601 gtaaattgat tgtacaaggg atccgtaagt tagacgaaat tttgtctttg cgcacagacg
 661 atctattttt tgcatccaat cagatttcct ttcgcattaa aaaaagacag aataaagaaa
 721 ccaaaattct aatcacattt cctatcagct taatggagga gttgcaaaaa tacacttgtg
 781 ggagaaatgg gagagtattt gtttctaaaa tagggattcc tgtaacaaca agtcaggttg
 841 cgcataattt taggcttgca gagttctata gtgctatgaa aataaaaatt actcctagag
 901 tacttcgtgc aagcgctttg attcatttaa agcaaatagg attaaaagat gaggaaatca
 961 tgcgtatttc ctgtctttca tcgagacaaa gtgtgtttc tgtgatataa ttattgttct gggggaagagg
1021 taagtccct agtacaaaca cccccaatat agcgagttac gaagacaaaa cctcttcgtt
1081 tgttgccaga aaaaacactt ttaggctata acttctgagg ataagttata ataatcctct
1141 ctcgagaaga tttatcgtac gcaaatatca tctttgcgt cttctttgaa gcgttgtctt
1201 ttatgtcgga gtctgagcac cctaggcgtt tgtactccgt tgcgtcct gtgaccttca
1261 cgtgcggggt tatcttaaaa gggattgcag cttgtagtcc cacagcggtt gctcgaagca
1321 cgatttgcct taacccacc attttttccgg agcgagttac gaagacaaaa cctcttcgtt
1381 gaccgatgta ctcttgtaga aagtgcataa acttctgagg ataagttata ataatcctct
1441 tttctgtctg acggttctta agctgggaga aagaaatggt agcttgttgg aaacaaatct
1501 gactaatctc caagcttaag acttcagagg agcgtttacc tccttgagc attgtctggg
1561 cgatcaacca atcccgggca ttgatttttt ttagctcttt taggaaggac gctgtttgca
```

FIG. 17A (cont.)

```
1621 aactgttcat cgcatctgtt tttactattt ccctggtttt aaaaaatgtt cgactatttt
1681 cttgtttaga aggttgcgct atagcgacta ttccttgagt catcctgttt aggaatcttg
1741 ttaaggaaat atagcttgct gctcgaactt gtttagtacc ttcggtccaa gaagtcttgg
1801 cagaggaaac ttttttaatc gcatctagaa ttagattatg atttaaaagg gaaaactctt
1861 gcagattcat atccaaggac aatagaccaa tcttttctaa agacaaaaaa gatcctcgat
1921 atgatctaca gtatgtttg ttgagtgatg cggtccaatg cataataact tcgaataagg
1981 agaagctttt catgcgtttc caataggatt cttggcgaat ttttaaaact tcctgataag
2041 acttttcgct atattctaac gacatttctt gctgcaaaga taaatccct ttaccatga
2101 aatccctcgt gatataacct atccgtaaaa tgtcctgatt agtgaaataa tcaggttgtt
2161 aacaggatag cacgctcggt atttttttat ataacatga aaactcgttc cgaaatagaa
2221 aatcgcatgc aagatatcga gtatgcgttg ttagtaaag ctctgatatt tgaagactct
2281 actgagtata ttctgaggca gcttgctaat tatgagttta agtgttctca tcataaaaac
2341 atattcatag tattaaaata cttaaaagac aatggattac ctataactgt agactcggct
2401 tgggaagagc ttttgcggcg tcgtatcaaa gatatggaca aatcgtatct cgggttaatg
2461 ttgcatgatg ctttatcaaa tgacaagctt agatccgttt ctcataccgt tttcctcgat
2521 gatttgagcg tgtgtagcgc tgaagaaaat ttgagtaatt tcatttccg ctcgtttaat
2581 gagtacaatg aaaatccatt gcgtagatct ccgtttctat tgcttgagcg tatagggaa
2641 aggcttgaca gtgctatagc tctattcgca gcgctagagg ccggtctatt
2701 tatgatatat tctcacagtc agaaattgga gtgctgcctc gtataaaaa aagacgagca
2761 acgttctctg agaatcaaa ttctttcttt gatgccttcc caacaggata caaggatatt
2821 gatgataaag gagttatctt agctaaaggt aatttcgtga ttatagcagc taggccatct
2881 ataggaaaa ctgctttagc tatagacatg gcgataaatc ttgcggttac tcaacagcgt
2941 agagttggtt tcctatctct agaaatgagc gcaggtcaaa ttgttgagcg gattattgct
3001 aatttaacag gaatatctgg tgaaaaatta caaagagggg atctctctaa agaagaatta
3061 ttccgagtag aagaagctgg agaagcagtt agaaatcac attttatat ctgcagtgat
3121 agtcagtata agcttaattt tatttatcga cagatccgaa cagatcggt tgctgagaaa agaagatcga
3181 gtagacgtaa tatttatcga ttacttgcag catcggttgg agaaaatcgt
3241 caaaatgaaa tagcagataa atctagaacc ttaagaggtt tagcctcaga gctaaacatt
```

FIG. 17A (cont.)

```
3301 cctatagttt gtttatccca actatctaga aaagttgagg atagagcaaa taaagttccc
3361 atgctttcag atttgcgaga cagcggtcaa atagagcaag acgcagatgt gatttgttt
3421 atcaatagga aggaatcgtc ttctaattgt gagataactg ttggaaaaa tagacatgga
3481 tcggtttct cttcggtatt acatttcgat ccaaaaatta gtaaattctc cgctattaaa
3541 aaagtatggt aaattatagt aactgccact tcatcaaaag tcctatccac cttgaaaatc
3601 agaagtttgg aagaagacct ggtcaatcta ttaagatatc tcccaaattg gctcaaaatg
3661 ggatggtaga agttataggt cttgattttc tttcatctca ttaccatgca ttagcagcta
3721 tccaaagatt gctgactgca acgaattaca agggaacac aaaaggggtt gttttatcca
3781 gagaatcaaa tagttttcaa tttgaaggat ggataccaag aatccgtttt acaaaaactg
3841 aattcttaga ggcttatgga gttaagcggt ataaacatc cagaaataag tatgagttta
3901 gtggaaaaga agctgaaact gcttagaag cttatacca tttaggacat caaccgttt
3961 taatagtggc aactagaact cgatggacta atggaacaca aatagtagac cgttaccaaa
4021 ctctttctcc gatcattagg atttacgaag gatggaagg tttaactgac gaagaaaata
4081 tagatataga cttaacacct tttaattcac catctacacg gaaacataaa gggttcgttg
4141 tagagccatg tcctatcttg gtagatcaaa tagaatccta ctttgtaatc aagcctgcaa
4201 atgtatacca agaaataaaa atgcgcttcc caaatgcatc aaagtatgct tacacattta
4261 tcgactgggt gattacagca gctgcgaaaa agagacgaaa attaactaag gataattctt
4321 ggccagaaaa cttgttctta aacgttaacg ttaaaagtct tgcatatatt ttaaggatga
4381 atcggtacat ttgtacaagg aactgaaaa aaatcgagtt agctatcgat aaatgtatag
4441 aaatcgccat tcagctggt tggttatcta gaagaaaacg cattgaattt ctggattctt
4501 ctaaactctc taaaaaagaa attctatatc taaataaaga gcgttttgaa gaaataacta
4561 agaaatctaa agaacaaatg gaacaattag aacaagaatc tattaattaa tagcaaactt
4621 gaaactaaaa acctaattta tttaaagctc aaaataaaaa agagtttaa aatgggaaat
4681 tctggttttt atttgtataa cactcaaaac tgcgtctttg ctgataatat caaagttggg
4741 caaatgacag agccgctcaa ggaccagcaa ataatccttg ggacaacatc aacacctgtc
4801 gcagccaaaa tgacagcttc tgatggaata tctttaacag tctccaataa tccatcaacc
4861 aatgcttcta ttacaattgg tttggatgcg gaaaagctt accagcttat tctagaaaag
4921 ttgggagatc aaattcttgg tggaattgct gatactattg gatactatac agtccaagat
```

FIG. 17A (cont.)

```
4981 attttagaca aaatcacaac agaccottct ctaggtttgt tgaaagcttt taacaacttt
5041 ccaatcacta ataaaattca atgcaacggg ttattcactc ccaggaacat tgaaactta
5101 ttaggaggaa ctgaaatagg aaaattcaca gtcacaccca aaagctctgg gagcatgttc
5161 ttagtctcag cagatatat tgcatcaaga atggaaggcg gcgttgttct agctttggta
5221 cgagaaggtg attctaagcc ctacgcgatt agttatggat actcatcagg cgttcctaat
5281 ttatgtagtc taagaaccag aattattaat acaggattga ctccgacaac gtattcatta
5341 cgtgtaggcg gtttagaaag cggtgtggta tgggttaatg ccctttctaa tggcaatgat
5401 attttaggaa taacaaatac ttctaatgta tctttttgg aggtaatacc tcaaacaaac
5461 gcttaaacaa tttttattgg atttttctta taggttttat atttagagaa aaaagttcga
5521 attacgggt ttgttatgca aaataaaagc aaagtgaggg acgattttat taaaattgtt
5581 aaagatgtga aaaaagattt cccgaatta gacctaaaaa tacgagtaaa caaggaaaaa
5641 gtaactttct taaattctcc cttagaactc taccataaaa gtgtctcact aattctagga
5701 ctgcttcaac aaatagaaaa ctctttagga ttattcccag actctcctgt tcttgaaaaa
5761 ttagaggata acagtttaaa gctaaaaaag gctttgatta tgcttatctt gtctagaaaa
5821 gacatgtttt ccaaggctga atagataact tactctaacg ttggagttga tttgcacacc
5881 ttagtttttt gctcttttaa gggaggaact ggaaaaacaa cactttctct aaacgtggga
5941 tgcaacttgg cccaatttt agggaaaaaa gtgttacttg ctgacctaga cccgcaatcc
6001 aatttatctt ctgattggg ggctagtgtc agaagtaacc aaaaaggctt acacgacata
6061 gtatacacat caaacgattt aaaatcaatc atttgcgaaa caaaaaaaga tagtgtggac
6121 ctaattcctg catcatttt atccgaacag tttagagaat tggatattca tagaggacct
6181 agtaacaact taaagttatt tctgaatgag tactgcgctc cttttatga catctgcata
6241 atagacactc cacctagcct aggagggtta acgaaagaag cttttgttgc aggagacaaa
6301 ttaattgctt gttaactcc agaaccttt tctattctag ggttacaaaa gatacgtgaa
6361 ttcttaagtt cggtcgaaa acctgaagaa gaacacattc ttgaatagc tttgtctttt
6421 tgggatgatc gtaactcgac taaccaaatg tatcgagtc ttatcaaa tatttacaaa
6481 aacaagcttt tttcaacaaa aattcgtcga gatatttctc tcagccgttc tcttcttaaa
6541 gaagattctg tagctaatgt ctatccaaat tctaggccg cagaagatat tctgaagtta
6601 acgcatgaaa tagcaaatat tttgcatatc gaatatgaac gagattactc tcagaggaca
```

FIG. 17A (cont.)

```
6661  acgtgaacaa actaaaaaaa gaagcgaatg tcttttttaa aaaaaatcaa actgccgctt
6721  ctttagattt taagaagacg cttccttcca ttgaactatt ctcagcaact ttgaattctg
6781  aggaaagtca gagtttggat caattatttt tatcagagtc ccaaaactat tcggatgaag
6841  aattttatca agaagacatc ctagcggtaa aactgcttac tggtcagata aaatccatac
6901  agaagcaaca cgtacttctt ttaggagaaa aaatctataa tgctagaaaa atcctgagta
6961  aggatcactt ctcctcaaca acttttcat cttggataga gttagttttt agaactaagt
7021  cttctgctta caatgctctt gcatattacg agctttttat aaacctcccc aaccaaactc
7081  tacaaaaaga gtttcaatcg atcccctata aatccgcata tatttttggcc gctagaaaag
7141  gcgatttaaa aaccaagtc gatgtgatag ggaaagtatg tggaatgtcg aactcatcgg
7201  cgataagggt gttggatcaa tttcttcctt catctagaaa caaagacgtt agagaaacga
7261  tagataagtc tgattcagag aagaatcgcc aattatctga tttcttaata gagatacttc
7321  gcatcatgtg ttccggagtt tctttgtcct tctttatcga cctataacga aaatcttcta caacgcttt
7381  ttgaactttt taagcaaaag agctgatcct ccgtcagctc atatatatat ctattatata
7441  tatatattta gggatttgat tttacgagag aga
```

FIG. 17B

Corresponding Amino Acid Sequence of Pgp1 (SEQ ID NO: 118):

MKTRSEIENRMQDIEYALLGKALIFEDSTEYILRQLANYEFKCSHHKNIFIVFKYLKDNGLPITVDSAWEELLRRRIKD
MDKSYLGIMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGVILAKGNFVIAARPSIGKTALAID
MAINLAVTQQRRVGFLSLEMSAGQIVERIIANLGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 17C
Corresponding Amino Acid Sequence of Pgp2 (SEQ ID NO: 119):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRKRIEFL
DSSKLSKKEILYLNKERFEEITKKSKEQMEQLEQESIN

FIG. 17D
Corresponding Amino Acid Sequence of Pgp3 (SEQ ID NO: 120):

MGNSGFYLYNTQNCVFADNIKVGQMTEPLKDQQIILGTTSTPVAAKMTASDGISLTVSNNPSTNASITIGLDAEKAYQL
ILEKLGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVWVNA
LSNGNDILGITNTSNVSFLEVIPQTNA

FIG. 17E
Corresponding Amino Acid Sequence of Pgp4 (SEQ ID NO: 121):

MQNKSKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 17F
Corresponding Amino Acid Sequence of Pgp5 (SEQ ID NO: 122):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKFLNEYCAPFYDICIIDTPPSLGLTKEAFVAGDKLIACLTPEPFSLGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 17G

Corresponding Amino Acid Sequence of Pgp6 (SEQ ID NO: 123):

MNKLKKEANVFFKKNQTAASLDFKKTLPSIELFSATLNSEESQSLDQLFLSESQNYSDEEFYQEDILAVKLLTGQIKSI
QKQHVLLGEKIYNARKILSKDHFSSTTFSSMIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLEILRIMCSGVSLSSYNENLLQ
QLFELFKQKS

FIG. 17H

Corresponding Amino Acid Sequence of Pgp7 (SEQ ID NO: 124):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEMTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFYSAMKIKITPRVLRASALIHLKQIGLKDEEIMRISCLSSRQSVCSYCSGEEVSPLVQTPPIL

FIG. 17I

Corresponding Amino Acid Sequence of Pgp8 (SEQ ID NO: 125):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLEKLKKINARDWLIAQTMLQGGKRSSEVLSLEISQICFQQATISFSQLKNRQTEKRIITYPQKEMHFLQEY
IGQRRGFVFVFVTRSGKMVGLRQIARTFSQAGLQAAIPFKITPHVLRATAVTEYKRLGCSDSDIMKVTGHATAKMIFAYDK
SSREDNASKKMALI

FIG. 18A

Nucleic Acid Sequence of Plasmid HE603228 (SEQ ID NO: 126):

```
   1 tttgcaactc ttggtggtag acttgcaac tcttggtggt agactttgca actccttggtg
  61 gtagactttg caactcttgg tggtagactt ggtcataatg gactttttgtt gaaaatttc
 121 ttaaaatctt agagctccga tttgaatag ctttggttaa gaaaatgggc tcgatggctt
 181 tccataaaag taggttgttc ttaactttg gggacgcgtc ggaaattcgg aaacctgat
 241 aaaggctatt tctccttgacc acagcgaatc tttgtttaaa atcaagtctc tagatgtttt
 301 taatgaaaaa gtcgtttcag aggcctctaa acaggctaga gcggcatgct acatatcttt
 361 cacaagttt ttgtatagat tgaccaaggg atatattaaa cccgctattc cattgaaaga
 421 tttggaaaac actacatttt ttaaaatccg agacaaaatc aaaacagaat cgatttctaa
 481 gcaggaatgg acagtttttt ttgaagcgct ccggatagtg aattatagag actatttaat
 541 cggtaaattg attgtacaag ggatccgtaa gttagacgaa attttgtctt tgcgcacaga
 601 cgatctattt ttttcatcca atcagatttc cttcgcatt cttccgcatt agaataaaga
 661 aaccaaaatt ctaatcacat ttcctatcag cttaatggag gagttgcaaa aatacacttg
 721 tgggagaaat gggagagtat ttgtttctaa aataggatt cctgtaacaa caagtcaggt
 781 tgcgcataat tttaggcttg cagagttcta tagtgctatg aaaataaaaa ttactcctag
 841 agtacttcgt gcaagcgctt tgattcattt aaagcaaata ggattaaaag atgaggaaat
 901 catgcgtatt cctgtctctt catcgagaca aagtgtgtgt tcttattgtt ctgggaaga
 961 ggtaagtcct ctagtacaaa caccccccaat attgtgatat aattaaaatt atattcatat
1021 tctgttgcca gaaaaaaacac tttaggcta catctttgcg gttgcgtgtc aagcgttgtc
1081 ttctcgagaa gatttatcgt acgcaaatat tttgtactcc gtcacagcgg ttgctgaag
1141 cattatgtcg gagtctgagc accctagcg aggtattgc agcttgtagt ccgtgttgag agaacgtgcg
1201 cacgtgcggg gttatcttaa aaggattgc agctgttgc ggagcgagtt acgaagacaa aacctcttcg
1261 ggcgattgc cttaacccca ccattttcc gaaacttctga ggataagtta taataatcct
1321 ttgaccgatg tactcttgta gaaagtgcat aaacttctga ggataagtta taataatcct
1381 ctttctgtc tgacggtct taagctggga gaaagaaatg gtagcttgtt ggaaacaaat
1441 ctgactaatc tccaagctta agacttcaga ggagcgttta cctcctgga gcattgtctg
1501 ggcgatcaac caatcccggg cattgatttt tttagctct tttaggaagg acgctgtttg
1561 caaactgttc atcgcatctg tttttactat ttccctggtt ttaaaaaatg ttcgactatt
```

FIG. 18A (cont.)

```
1621 ttcttgttta gaaggttgcg ctatagcgac tattccttga gtcatcctgt ttaggaatct
1681 tgttaaggaa atatagcttg ctgctcgaac ttgtttagta ccttcggtcc aagaagtctt
1741 ggcagaggaa acttttttaa tcgcatctag aattagatta tgatttaaaa gggaaaactc
1801 ttgcagattc atatccaagg acaatagacc aatcttttct aaagacaaaa aagatcctcg
1861 atatgatcta caagtatgtt tgttgagtga tgcggtccaa tgcataataa cttcgaataa
1921 ggagaagctt ttcatgcgtt tccaatagga ttcttggcga atttttaaaa cttcctgata
1981 agacttttcg ctatattcta acgacatttc ttgctgcaaa gataaaatcc ctttaccoat
2041 gaaatccctc gtgataaac ctatccgtaa aatgtcctga ttagtgaaat aatcaggttg
2101 ttaacaggat agcacgctcg gtatttttt atataaacat gaaaactcgt tccgaaatag
2161 aaaatcgcat gcaagatatc gagtatgcgt tgttaggtaa agctctgata tttgaagact
2221 ctactgagta ttctgagg cagcttgcta attatgagtt taagtgttct catcataaaa
2281 acatattcat agtattaaa tacttaaaag acaatggatt acctataact gtagactcgg
2341 cttgggaaga gcttttgcgg cgtcgtatca aagatatgga caaatcgtat ctcggttaa
2401 tgttgcatga tgctttatca aatgacaagc ttagatccgt ttctcatacg gttttcctcg
2461 atgatttgag cgtgtgtagc gctgaagaaa atttgagtaa tttcattttc cgctcgttta
2521 atgagtacaa tgaaaatcca ttgccgtagat ctccgtttct attgcttgag cgtataaagg
2581 gaaggcttga cagtgctata gcaaagactt tttctattcg cagcgctaga ggccggtcta
2641 tttatgatat attctcacag tcagaaattg gagtgctgcc tcgtataaaa aaaagacgag
2701 caacgttctc tgaaatcaa aattctttct ttgatgcctt cccaacagga tacaaggata
2761 ttgatgataa aggagttatc ttagctaaag gtaatttcgt gattatagca gctagccat
2821 ctataggaa aactgcttta gctatagaca tggcgataaa tcttgcggtt actcaacagc
2881 gtagagttgg tttcctatct ctagaaaatga gcgcaggtca aattgttgag cggattattg
2941 ctaattaac aggaaatatct ggtgaaaaat tacaaagagg ggatctctct aaagaagaat
3001 tattccgagt agaagaagct ttaatcgcga atcagatccg gttgctgaga acattttat atctgcagtg
3061 atagtcagta taagcttaat ttaatcgcga atcagatccg gttgctgaga aaagaagatc
3121 gagtagacgt aatatttatc gattacttgc agttgatcaa ctcatcggtt ggagaaaatc
3181 gtcaaaatga aatagcagat atatctagaa ccttaagagg tttagcctca gagctaaaca
```

FIG. 18A (cont.)

```
3241 ttcctatagt ttgcttatcc caactatcta gaaaagttga ggatagagca aataaagttc
3301 ccatgcttc  agatttgcga gacagcggtc aaatagagca agacgcagat gtgattttgt
3361 ttatcaatag gaaggaatcg tcttctaatt gtgagataac tgttgggaaa aatagacatg
3421 gatcggtttt ctcttcggta ttacatttcg atccaaaaat tagtaaattc tccgctatta
3481 aaaagtatg  gtaaattata gtaactgcca cttcatcaaa agtcctatcc accttgaaaa
3541 tcagaagttt ggaagaagac ctggtcaatc ctgtcaatc  tattaagata tctcccaaat tggctcaaaa
3601 tgggatggta gaagttatag gtcttgattt tctttcatct cattaccatg cattagcagc
3661 tatccaaaga ttgctgactg caacgaatta caagggaac  acaaaagggg ttgttttatc
3721 cagagaatca aatagttttc aatttgaagg atggatacca agaatccgtt ttacaaaaac
3781 tgaattctta gaggcttatg gagttaagcg gtataaaaca tccagaaata agtatgagtt
3841 tagtgaaaa  gaagctgaaa ctgctttaga agccttatac catttaggac atcaaccgtt
3901 tttaatagtg gcaactagaa ctcgatggac taatggaaca caatagtag  accgttacca
3961 aactctttct ccgatcatta ggattacga  aggatgggaa ggtttaactg acgaagaaaa
4021 tatagatata gacttaacac cttttaattc accatctaca cggaaacata aagggttcgt
4081 tgtagagcca tgtcctatct tggtagatca aatagaatcc tactttgtaa tcaagcctgc
4141 aaatgtatac caagaaataa aaatgcgctt cccaaatgca tcaaagtatg cttacacatt
4201 tatcgactgg gtgattacag cagctgcgaa aaagagacga aaattaacta aggataattc
4261 ttggccagaa aacttgttct taaacgttaa cgttaaaagt cttgcatata tttaaggat
4321 gaatcggtac atttgtacaa ggaactgaaa aaaaatcgag ttagctatcg ataaatgtat
4381 agaaatcgcc atcagcttg  gttggttatc tagaagaaaa cgcattgaat ttctggattc
4441 ttctaaactc tctaaaaaag aaattctata tctaaataaa gagcgttttg aagaaataac
4501 caagaaatct aaagaacaat tggaacaatt agaacaagaa tctattaatt aatagcaaac
4561 ttgaaactaa aaacctaatt tatttaaagc tcaaaataaa aaagagttt  aaaatgggaa
4621 attctggttt ttatttgtat aacactcaaa actgcgtctt tgctgataat atcaaagttg
4681 ggcaaatgac agagccgctc aaggaccagc aaataatcct tggacaaca  tcaacacctg
4741 tcgcagccaa aatgacagct tctgatggaa tatctttaac agtctccaat aatccatcaa
4801 ccaatgcttc tattacaatt ggtttggatg cggaaaaagc ttaccagctt attctagaaa
4861 agttgggaga tcaaattctt ggtggaattg ctgatactat tgttgatagt acagtccaag
```

FIG. 18A (cont.)

```
4921 atattttaga caaaatcaca acagacccct ctctaggttt gttgaaagct tttaacaact
4981 ttccaatcac taataaaatt caatgcaaacg ggttattcac tcccaggaac attgaaactt
5041 tattaggagg aactgaaata ggaaaattca cagtcacacc caaaagctct gggagcatgt
5101 tcttagtctc agcagatatt attgcatcaa gaatggaagg cggcgttgtt ctagcttttgg
5161 tacgagaagg tgattctaag ccctacgcga ttagttatgg atactcatca ggcgttccta
5221 atttatgtag tctaagaacc agaattatta atacaggatt gactccgaca acgtattcat
5281 tacgtgtagg cggtttagaa agcggtgtgg tatgggttaa tgcccttct aatggcaatg
5341 atattttagg aataacaaat acttctaatg tatctttttt ggaggtaata cctcaaacaa
5401 acgcttaaac aattttttatt ggattttct tataggtttt atatttagag aaaaaagttc
5461 gaattacggg gtttgttatg caaaataaaa gcaaagtgag ggacgatttt attaaaattg
5521 ttaaagatgt gaaaaaagat ttccccgaat tagacctaaa aatacgagta aacaagaaaa
5581 aagtaacttt cttaaattct cccttagaac tctaccataa aagtgtctca ctaattctag
5641 gactgcttca acaaatagaa aactcttttag gattattccc agactctcct gttcttgaaa
5701 aattagagga taacagttta aagctaaaaa aggctttgat tatgcttatc ttgtctagaa
5761 aagacatgtt ttccaaggct gaatagataa cttactctaa cgttggagtt gatttgcaca
5821 cctagttttt ttgctctttt aagggaggaa ctgaaaaaac aacacttct ctaaacgtgg
5881 gatgcaactt gcccaattt ttagggaaaa aagtgttact tgctgaccta gacccgcaat
5941 ccaattatc ttctggattg ggggctagtg tcagaagtaa ccaaaaaggc ttacacgaca
6001 tagtatacac atcaaacgat ttaaaatcaa tcatttgcga aacaaaaaaa gatagtgtgg
6061 acctaattcc tgcatcattt ttatccgaac agtttagaga attggatatt catagaggac
6121 ctagtaacaa cttaaagtta tttctgaatg agtactcgcg tccttttat gacatctgca
6181 taatagacac tccacctagc ctagaggggt aacgaaaaga agcttttgtt gcaggagaca
6241 aattaattgc ttgtttaact ccagaacctt tttctattct agggttacaa aagatacgtg
6301 aattcttaag ttcggtcgga aaacctgaag aagaacacat tcttggaata gctttgtctt
6361 tttggatga tcgtaactcg actaaccaaa tgtatataga cattatcgag tctatttaca
6421 aaaacaagct tttttcaaca aaaattcgtc agatatttc tctcagccgt tctcttctta
6481 aagagattc tgtagctaat gtctatccaa attctaggc cgcagaagat attctgaagt
6541 taacgcatga aatagcaaat attttgcata tcgaatatga acgagattac tctcagagga
```

FIG. 18A (cont.)

```
6601 caacgtgaac aaactaaaaa aagaagcgaa tgtcttttt aaaaaaatc aaactgccgc
6661 ttctttagat tttaagaaga cgcttcctc cattgaacta ttctcagcaa cttgaattc
6721 tgaggaaagt cagagtttgg atcaattatt tttatcagag tcccaaaact attcggatga
6781 agaattat caagaagaca ctccagcgtt aaaactgctt actggtcaga taaaatccat
6841 acagaagcaa ttctcctcaa ttttaggaga aaaaatctat aatgctagaa aaatcctgag
6901 taaggatcac gtctctgct tacaatgctc caactttc atcttggata gagttagttt ttagaactaa
6961 gtcttctgct tacaatgctc ttgcatatta cgagctttt ataaacctcc ccaaccaaac
7021 tctacaaaaa gagtttcaat cgatccccta taaatccgca tatattttgg ccgctagaaa
7081 agcgattta aaaaccaagg tcgatgtgat agggaaagta tgtggaatgt cgaactcatc
7141 ggcgataagt gtgttggatc aatttcttcc ccaattatct gatttcttaa ttagagaaac
7201 gatagataag tctgattcag agaagaatcg agaagaatcg ccaattatct gatttcttaa tagagatact
7261 tcgcatcatg tgttccggag tttcttgtc ctcctataac gaaatcttc tacaacagct
7321 tttgaactt tttaagcaaa agagctgatc ctccgtcagc tcatatata atctattata
7381 tatatatatt tagggatttg attttacgag agaga
```

FIG. 18B

Corresponding Amino Acid Sequence of Pgp1 (SEQ ID NO: 127):

MKTRSEIENRMQDIEYALLGKALIFEDSTEYILRQLANYEFKCSHHKNIFTVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLREDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 18C

Corresponding Amino Acid Sequence of Pgp2 (SEQ ID NO: 128):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRKRIEFL
DSSKLSKKEILYLNKERFEEITKKSKEQMEQLEQESIN

FIG. 18D

Corresponding Amino Acid Sequence of Pgp3 (SEQ ID NO: 129):

MGNSGFYLYNTQNCVFADNIKVGQMTEPLKDQQIILGTTSTPVAAKMTASDGISLTVSNNPSTNASITIGLDAEKAYQL
ILEKLGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVVWVNA
LSNGNDILGITNTSNVSFLEVIPQTNA

FIG. 18E

Corresponding Amino Acid Sequence of Pgp4 (SEQ ID NO: 130):

MQNKSKVRDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 18F

Corresponding Amino Acid Sequence of Pgp5 (SEQ ID NO: 131):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKFLNEYCAPFYDICIIDTPPSLGGLTKEAFVAGDKLIACLTPEPFSIIGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 18G

Corresponding Amino Acid Sequence of Pgp6 (SEQ ID NO: 132):

MNKLKKEANVFFKKNQTAASLDFKKTLPSIELFSATLNSEESQSLDQLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 18H

Corresponding Amino Acid Sequence of Pgp8 (SEQ ID NO: 133):

MGKGILSLQQEMSLEYSEKSYQEVLKIRQESVWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 19A

Nucleic Acid Sequence of Plasmid HE603230 (SEQ ID NO: 134):

```
   1 tttgcaactc ttggtggtag actttgcaac tcttggtggt agactttgca atctttgtgg
  61 tagactttgc aactcttggt ggtagacttg gtcataatgg acttttgtta aaaaatttct
 121 taaaatctta gagctccgat tttgaatagc tttggtttaag aaaatgggct cgatggcttt
 181 ccataaaagt agattgttct taacttttgg ggacgcgtcg gaaatttggt tatctacttt
 241 atctcatcta actagaaaaa attatgcgtc tgggattaac tttcttgttt cttagagat
 301 tctggattta tcggaaacct tgataaaggc tatttctctt gaccacagcg aatctttgtt
 361 taaaatcaag tctctagatg ttttttaatgg aaaagtcgtt tcagaggcct ctaaacaggc
 421 tagagcggca tgctacatat cttcacaaa gttttttgtat agattgacca aggatatat
 481 taaacccgct attccattga aagattttgg aaacactaca tttttaaaa tccgagacaa
 541 aatcaaaaca gaatcgattt ctaagcagga atggacagtt tttttgaag cgctccggat
 601 agtgaattat agagactatt taatcggtaa attgattgta caaggatcc gtaagttaga
 661 cgaattttg tctttgcgca cagacgatct atttttgca tccaatcaga tttcctttcg
 721 cattaaaaaa agacagaata aagaaaccaa aattctaatc acattccta tcagcttaat
 781 ggaagagttg caaaatac ct tgtgggag aaatgggaga gtatttgttt ctaaaatag g
 841 gattcctgta acaacaagtc aggttgcgca taattttagg cttgcagagt tccatagtgc
 901 tatgaaaata aaaattactc ccagagtact tcgtgcaagc gctttgattc attaaaagca
 961 aataggatta aagatgaggg aaatctgtt tcctctagta caaacaccca caatattgtg
1021 gtgttcttat tgtccccgtg aagaggattta acactttag tcgtacgcaa atatcatctt
1081 atataattaa tttgaagcgt cccttcattat gtcggagtct gagcaccta ggcgtttgta
1141 agccatcttc tgtcccgtga cctt cattat gtcggagtct ttaaaaggga ttgcagcttg
1201 tgcggttgcg tgtccgtgca ttgcgggcgat ttgccttaac cccaccattt ttccggagcg
1261 ctccgtcaca gcggttgctc gaagcacgtg tgcgggcgat cccaccattt ttccggagcg
1321 tagtcctgct tgagagaacg tgcgggcgat ttcgttgacc gatgtactct tgtagaaagt gcataaactt
1381 agttacgaag acaaaacctc ttcgttgacc gatgtactct tgtagaaagt gcataaactt
1441 ctgaggataa gttataataa tcctcttttc tgtctgacgg ttcttaagct gggagaaaga
1501 aatggtagct tgttggaaac aaatctgact aatctccaag cttaagactt cagaggagcg
1561 tttacctcct tggagcattg tctggggcgat caaccaatcc cgggcgttga ttttttttag
```

FIG. 19A (cont.)

```
1621 ctcttttagg aaggatgctg tttgcaaact gttcatcgca tccgttttta ctatttcct
1681 ggttttaaaa aatgttcgac tattttcttg tttagaaggt tgcgctatag cgactattcc
1741 ttgagtcatc ctgtttagga atcttgttaa ggaaatattag cttgctgctc gaacttgttt
1801 agtaccttcg gtccaagaag tcttggcaga ggaaacttt ttaatcgcat ctaggattag
1861 attatgattt aaaaggaaa actcttgcag attcatatcc aaagacaata gaccaatctt
1921 ttctaaagac ataacttcga ctcgatatga tctacaagta tgtttgttga gtgatgcggt
1981 ccaatgcata aaaaatgcct ataaggagaa gcttttcatg cgtttccaat aggattcttg
2041 gcgaatttt aaaacttcct gataagactt tcgctatat tctaacgaca tttcttgctg
2101 caaagataaa atcccttac ccatgaaatc cctcgtgata taacctatcc gcaaaatgtc
2161 ctgattagtg aaataatcag gttgttaaca ggatagcacg ctcgtattt ttttatataa
2221 acatgaaaac tcgttccgaa atagaaaatc gcatgcaaga tatcgagtat gcgttgttag
2281 gtaaagctct gatatttgaa gactctactg agtatattct gaggcagctt gctaattatg
2341 agtttaagtg ttcccatcat aaaaacatat tcatagtatt taaatactta aaagacaatg
2401 gattacctat aactgtagac tcggcttggg aagagcttt gcggcgtcgt atcaaagata
2461 tggacaaatc gtatctcggg ttaatgttgc atgatgcttt atcaaatgac aagcttagat
2521 ccgttctca tacggttttc ctcgatgatt tgagcgtgtg tagcgctgaa gaaaatttga
2581 gcaatttcat tttccgctcg tttaatgagt acaatgaaaa tccattgcgt agatctccgt
2641 ttctattgct tgagcgtata aagggaaggc ttgatagtgc ttgatagtgc actttttcta
2701 ttcgcagcgc tagaggccgg tctatttatg atatattctc acagtcagaa attggagtgc
2761 tggctcgtat aaaaaaaaga cgagcagcgt tctctgagaa tcaaaattct ttctttgatg
2821 gcttcccaac aggatacaag gatattgatg ataaaggagt tatcttagct aaaggtaatt
2881 tcgtgattat agcagctagg ccatctatag tttgtttcct atctctagaa gacatggcga
2941 taaatcttgc ggttactcaa cagcgtagaa ttggtttcct atctgtgaa atgagcgcag
3001 gtcaaattgt tgagcggatt gttgctaatt taacaggaat atctggtgaa aaattacaaa
3061 gaggggatct ctctaaagaa gaattattcc gagtggaaga agctggagaga acagttagag
3121 aatcacattt ttatatctgc agtgatagtc agtataagct taatttaatc gcgaatcaga
3181 tccggttgct gagaaaagaa gatcgagtag acgtaatatt tatcgattac ttgcagttga
3241 tcaactcatc ggttggagaa aatcgtcaaa atgaaatagc agatatatct agaaccttaa
```

FIG. 19A (cont.)

```
3301 gaggtttagc ctcagagcta aacattccta tagtttgttt atcccaacta tctagaaaag
3361 ttgaggatag agcaaataaa gttcccatgc tttcagattt gcgagacagc ggtcaaatag
3421 agcaagacgc agatgtgatt ttgtttatca ataggaagga atcgtcttct aattgtgaga
3481 taactgttgg gaaaaataga catggatcgg ttttctcttc ggtattacat ttcgatccaa
3541 aaattagtaa attctccgct attaaaaaag tatggtaaat tatagtaact gccacttcat
3601 caaaagtcct atccaccttg aaaatcagaa gtttggaaga agacctggtc aatctattaa
3661 gatatctccc aaattgctc aaaatgggat ggtagaagtt ataggtcttg attttcttc
3721 atctcattac catgcattag cagctatcca aagattactg accgcaacga attacaaggg
3781 gaacacaaaa ggggttgttt tatccagaga atcaaatagt tttcaatttg aaggatggat
3841 accaagaatc cgtttacaa aaactgaatt cttagagct tatggagtta agcgtataa
3901 aacatccaga aataagtatg agtttagtgg aaaagaagct gaaactgctt tagagcctt
3961 gtaccattta ggacatcaac cgtttttaat agtggcaact agaactcgat ggactaatg
4021 aacacaaata gtagaccgtt accaactct ttctccgatc attaggattt acgaaggatg
4081 ggaaggttta actgacgaag aaaatataga tatagactta acacctttta attcaccatc
4141 tacacggaaa cataaggat tcgttgtaga gccatgtcct atcttggtag atcaaataga
4201 atcctactttt gtaatcaagc ctgcaaatgt ataccaagaa ataaaaatgc gtttcccaaa
4261 cgcatcaaag tatgcttaca catttctcga ctgggtgatt acagcagctg cgaaaaagag
4321 acgaaaatta actaaggata attcttggcc agaaaacttg ttattaaacg ttaacgttaa
4381 aagtcttgca tatattttaa ggatgaatcg gtacatctgt acaaggaact ggaaaaaaat
4441 cgagttagct atcgataaat gtatagaaat cgccattcag cttggctggt tatctagaag
4501 aaaacgcatt gaatttctgg attcttctaa actctctaaa aaagaaattc tatatctaaa
4561 taaagagcgc tttgaagaaa taactaagaa atctaaagaa caaatggaac aagaatctat
4621 taattaatag caggcttgaa actaaaaacc taatttattt aaagctcaaa ataaaaaaga
4681 gttttaaaat gggaaattct ggttttatt tgtataacac gtctttgctg gtctttgctg
4741 ataatatcaa agttggcaa atgacagagc cgctcaagga ccagcaaata atcctttgga
4801 caaaatcaac acctgtcgca gccaaaatga cagcttctga tggaatatct ttaacagtct
4861 ccaataattc atcaaccaat gctctatta caattggttt ggatgcggaa aaagcttacc
4921 agcttattct agaaaagttg ggaaatcaaa ttcttgatgg aattgctgat actattgttg
```

FIG. 19A (cont.)

```
4981 atagtacagt ccaagatatt ttagacaaaa tcacaacaga cccttctcta ggtttgttga
5041 aagctttaa caactttcca atcactaata aaattcaatg caacgggtta ttcactccca
5101 gtaacattga aactttatta ggaggaactg aaataggaaa attcacagtc acacccaaaa
5161 gctctgggag catgttctta gtctcagcag atattattgc atcaagaatg gaaggcggcg
5221 ttgttctagc tttggtacga gaaggtgatt ctaagccctg cgcgattagt tatgatact
5281 catcaggcgt tcctaattta tgtagtctaa gaaccagcat tactaataca ggattgactc
5341 caacaacgta ttcattacgt gtaggcggtt tagaaagcgg tgtggtatgg gttaatgccc
5401 tttctaatgg caatgatatt ttaggaataa caaatacttc taatgtatct ttttggaag
5461 taatacctca aacaaacgct taaacaattt ttattggatt ttctttatag gttttatatt
5521 tagagaaaac agttcgaatt acggggtttg ttatgcaaaa taaaagaaaa gtgagggacg
5581 attttattaa aattgttaaa gatgtgaaaa aagatttccc cgaattagac ctaaaaatac
5641 gagtaaacaa ggaaaaagta actttcttaa atctcccctt agaactctac cataaaagtg
5701 tctcactaat tctaggactg cttcaacaaa tagaaaactc tttaggatta ttcccagact
5761 ctcctgttct tgaaaaatta gaggataaca gtttaaaget aaaaaaaggct ttgattatgc
5821 ttatctttgtc tagaaaagac atgtttttcca aggctgaata gacaacttac tctaacgttg
5881 gagttgattt gcacaccta gtttttttgct cttttaaggg aggaactgga aaaacaacac
5941 tttctctaaa cgtgggatgc aacttggccc aatttttagg gaaaaaaagtg ttacttgctg
6001 acctagaccc gcaatccaat ttatcttctg gattggggc tagtgtcaga aataaccaaa
6061 aaggcttgca cgacatagta tacaaatcaa acgatttaaa atcaatcatt tgcgaaacaa
6121 aaaaagatag tgtggacta tgcatcat cattttatc cgaacagttt agagaattgg
6181 atattcatag aggacctagt aacaacttaa agttattttct gaatgagtac tgcgctcctt
6241 tttatgacat ctgcataata gacactccac ctagcctagg agggtttaacg aaagaagctt
6301 ttgttgcagg agacaaatta attgcttgtt taactccaga accttttct attctagggt
6361 tacaaaagat acgtgaattc ttaagttcgg tcggaaaacc tgaagaagaa cacattcttg
6421 gaatagcttt gtctttttgg gatgatcgta actcgactaa ccaaatgtat atagacatta
6481 tcgagtctat ttacaaaaac aagcttttt caacaaaaat tcgtcgagat atttctctca
6541 gccgttctct tcttaaagaa gattctgtag ctaatgtcta tccaaattct aggccgcag
```

FIG. 19A (cont.)

```
6601 aagatattct gaagttaacg catgaaatag caaatatttt gcatatcgaa tatgaacgag
6661 attactctca gaggacaacg tgaacaaact aaaaaaagaa gcggatgtct ttttaaaaa
6721 aaatcaaact gccgcttctc tagattttaa gaagacactt cctccattg aactattctc
6781 agcaactttg aattctgagg aaagtcagag tttggatcga ttattttat cagagtccca
6841 aaactattcg gatgaagaat tttatcaaga agacatccta gcggtaaaac tgcttactgg
6901 tcagataaaa tccatacaga agcaacagt atcactctc ggagaaaaaa tctataatgc
6961 tagaaaaatc ctgagtaagg ctgcttacaa tttcatctt ggatagagtt
7021 agtttttaga actaagtctt ctgcttgca ttacgagc ttttatataa
7081 cctcccaac caaactctac aaaaagagtt tcaatcgatc cctataaat ccgcatatat
7141 tttggccgct agaaaaggcg atttaaaaac caggtcgat gtgataggga aagtatgtgg
7201 aatgtcgaac tcatcggcga taagggtgtt ggatcaattt cttcctcat ctagaaacaa
7261 agacgttaga gaaacgatag ataagtctga tttagagaag aatcgccaat tatctgattt
7321 cttaatagag atacttcgca tcatatgttc cggagtttct ttgtcctcct ataacgaaaa
7381 tcttctacaa cagcttttttg aactttttaa gcaaaagagc tgatcctccg tcagctcata
7441 tatatattta ttatatat atttatttag ggattgatt ttacgagaga ga
```

FIG. 19B

Corresponding Amino Acid Sequence of Pgp1 (SEQ ID NO: 135):

MKTRSEIENRMQDIEYALLGKALIFEDSTEYILRQLANYEFKCSHHKNIFIVFKYLKDNG_PITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFEDGFPTGYKDIDDKGVILAKGNFVIAARPSIGKTALAID
MAINLAVTQQRRVGFLSLEMSAGQIVERIVANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSNCEITVGKNRHGSVFSSVLHFDPKISKFSAIKKVW

FIG. 19C

Corresponding Amino Acid Sequence of Pgp2 (SEQ ID NO: 136):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQESIN

FIG. 19D

Corresponding Amino Acid Sequence of Pgp3 (SEQ ID NO: 137):

MGNSGFYLYNTENCVFADNIKVGQMTEPLKDQQIILGTKSTPVAAKMTASDGISLTVSNNSSTNASITIGLDAEKAYQL
ILEKLGNQILDGIADTIVDSTVQDILDKITTDPSIGLLKAFNNFPITNKIQCNGLFTPSNIETLLGGTEIGKFTVTPKS
SGSMFLVSADIIASRMEGGVVLALVREGDSKPCAISYGYSSGVPNLCSLRTSITNTGLTPTTYSLRVGGLESGVWWNA
LSNGNDILGITNTSNVSFLEVIPQTNA

FIG. 19E

Corresponding Amino Acid Sequence of Pgp4 (SEQ ID NO: 138):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 19F

Corresponding Amino Acid Sequence of Pgp5 (SEQ ID NO: 139):

MHTLVFCSFKGGTGKTTLSLNVGCNLAQFLGKKVLLADLDPQSNLSSGLGASVRNNQKGLHDIVYKSNDLKSIICETKK
DSVDLIPASFLSEQFRELDIHRGPSNNLKFLNEYCAPFYDICIIDTPPSLGGLTKEAFVAGDKLIACLTPEPFSILGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 19G

Corresponding Amino Acid Sequence of Pgp6 (SEQ ID NO: 140):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDLEKNRQLSDFLIEILRIICSGVSLSSYNENLLQ
QLFELFKQKS

FIG. 19H

Corresponding Amino Acid Sequence of Pgp7 (SEQ ID NO: 141):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 19I

Corresponding Amino Acid Sequence of Pgp8 (SEQ ID NO: 142):

MGKGILSLQQEMSLEYSEKSYQEVLKIRQESYWKRMKSFSLFEVIMHWTASINKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSEISQICFQQATISFSQLKNRQTEKRIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 20A

Nucleic Acid Sequence of Plasmid HE603232 (SEQ ID NO: 143):

```
   1 tttgcaactc ttggtggtag actttgcaac tcttggtggt agactttgca actcttggtg
  61 gtagactttg caactcttgg tgtagactt tgtcataatg ggtcataatg gacttttgtt aaaaatttc
 121 ttaaaatctt agagctccga tttgaatag cttttggtta gaaaatgggc tcgatggctt
 181 tccataaaag tagattgttt ttaactttg gggacgcgtc ggaaatttgg ttatctactt
 241 tatcttatct aactagaaaa aattatgcgt ctggattaa ctttcttgtt tctttagaga
 301 ttctggattt atcggaaacc ttgataaagg ctattctct tgaccacagc gaatctttgt
 361 ttaaaatcaa gtctctagat gtttttaatg gaaaagttgt ttcagaggca tctaaacagg
 421 ctagagcggc atgctacata tctttcacaa agtttttgta tagattgacc aaggatata
 481 ttaaacccgc tattccattg aaagattttg gaaacactac attttttaa atccgagaca
 541 aaatcaaaac agaatcgatt tctaagcagg aatggacagt tttttttgaa gcgctccgga
 601 tagtgaatta tagagactat ttaatcggta aattgattgt acaaggatc cgtaagttag
 661 acgaaatttt gtctttgcgc acagacgatc tatttttgc atccaatcag atttcctttc
 721 gcattaaaaa aagacagaat aaagaaacca aaattctaat cacatttcct atcagcttaa
 781 tggaagagtt gcaaaaatac acttgtggga gaaatgggag agtatttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttgatt cattaaaagc
 961 aaataggatt aaaagatgag gaaatcatgc gtatttcctg tcttccatcg agacaaaagtg
1021 tgtgttctta ttgttctggg gaagaggtaa ttcctctagt acaaacaccc acaatattgt
1081 gatataatta aaattatatt catattctgt tgccagaaaa aacaccttta ggctatatta
1141 gagccagctt ctttgaagcg ttgtcttctc gagaagattt atcgtacgca aatatcatct
1201 ttgcgttgc gtgtcctgtg accttcatta tgtcggagtc tgagcaccct aggcgtttgt
1261 actccgtcac agcggttgct cgaagcacgt gtcggggtta tttgccttaa tttaaaaggg attgcagctt
1321 gtagtcctgc ttgagagaac gtgcgggcga tttgccttaa ccccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgttggaaa caaatctgac taatctccaa gctaagact tcagaggagc
1561 gtttacctcc ttggagcatt gtctgggcga tcaaccaatc ccgggcattg atttttta
```

FIG. 20A (cont.)

```
1621 gctcttttag gaaggatgct gtttgcaaac tgttcatcgc atccgttttt actatttccc
1681 tggttttaaa aaatgttcga ctattttctt gtttagaagg ttgcgctata gcgactattc
1741 cttgagtcat cctgtttagg aatcttgtta aggaaatata gcttgctgct cgaacttgtt
1801 tagtaccttc ggtccaagaa gtcttggcag aggaaacttt tttaatcgca tctaggatta
1861 gattatgatt taaaaggaa aactcttgca caaggacaat caaggacaat agaccaatct
1921 tttctaaaga caaaaaagat cctcgatatg atctacaagt atgtttgttg agtgatgcgg
1981 tccaatgcat aataacttcg agcttttcat gcgttttccaa taggattctt
2041 ggcgaatttt taaaacttcc tgataagact tttcactata ttctaacgac atttcttgct
2101 gcaaagataa aatcccttta cccatgaaat ataacctatc cgtaaaatgt
2161 cctgattagt gaataatca ggttgttaac aggatagcac gctcggtatt tttttatata
2221 aacatgaaaa ctcgttccga aatagaaaat cgcatgcaag atatcgagta tgcgttgtta
2281 ggtaaagctc tgatatttga agactctact gagtatattc tgaggcagct tgctaattat
2341 gagtttaagt gttctcatca taaaaacata ttcatagtat ttaaatactt aaaagacaat
2401 ggattaccta taactgtaga ctcggcttgg gaagagcttt tgcggcgtcg tatcaaagat
2461 atggacaaat cgtatctcgg gttaatgttg catgatgctt tatcaaatga caagcttaga
2521 tccgttttct atacggtttt cctcgatgat ttgagcgtgt gtagcgctga agaaaatttg
2581 agtaatttca tttccgctc gtttaatgag tacaatgaaa atccattgcg tagatctccg
2641 tttctattgc ttgagcggat aaagggaagg cttgataggt ctatagcaaa gacttttct
2701 attcgcagcg gtctatttat gtctatttat gatatattct cacagtcaga aattggagtg
2761 ctggctcgta taaaaaaag acgagtagcg ttctctgaga atcaaaattc tttctttgat
2821 ggcttcccaa caggatacaa ggatattgat gataaggag gggaaaacag taaaggtaat
2881 ttcgtgatta tagcagctag accatctata gttggttttcc ctttagctat agacatggcg
2941 ataaatcttg cggttactca acagcgtaga tattgctaat tatctctaga aatgagcgca
3001 ggtcaaattg ttgagcggat tattgctaat ttaacaggaa tatctggtga aaaattacaa
3061 agagggggatc tctctaaaga agaattattc cgagtagaag aagctggaga aacggttaga
3121 gaatcacatt tttatatctg cagtgatagt cagtatataagc ttaacttaat cgcgaatcag
3181 atccggttgc tgagaaaaga agatcgagta gacgtaatat cagtatataagc cttgcagttg
```

FIG. 20A (cont.)

```
3241 atcaactcat cggttggaga aaatcgtcaa aatgaaatag cagatatatc tagaacctta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccacctt gaaaatcaga agtttggaag aagacctggt caatctatta
3661 agatatctcc caaattggct caaaatggga agttagaagt tataggtctt gatttctttt
3721 catctcatta ccatgcatta gcagctatcc aaagattact gaccgcaacg aattacaagg
3781 ggaacacaaa agggtttgtt ttatccagag aatcaaatag tttcaattt gaaggatgga
3841 taccaagaat ccgttttaca aaaactgaat tcttagaggc tcttagaggt aagcggtata
3901 aaacatccag aaataagtat gagtttagtg gaaaagaagc tgaaactgct ttagaagcct
3961 tataccattt aggacatcaa ccgttttta accaaactc tagtgcaac tgaactcga tggactaatg
4021 gaacacaaat agtagaccgt taccaaactc tttctccgat cattaggatt tacgaaggat
4081 gggaagttt aactgacgaa gaaatatag atatagactt aacacctttt aattcaccac
4141 ctacacgaa acatacaggg ttcgttgtag agccatgtcc tatcttggta gatcaaatag
4201 aatcctact tgtaatcaag cctgcaaatg tataccaaga aataaaaatg cgtttccaa
4261 atgcatcaaa gtatgcttac acatttatcg actgggtgat tacagcagct gcgaaaaaga
4321 gacgaaaatt aactaaggat aattcttggc cagaaaactt gttattaaac gttaacgtta
4381 aaagtcttgc atatatttta aggatgaatc ggtacatctg tacaaggaac tggaaaaaaa
4441 tcgagttagc tatcgataaa tgtatagaaa gcttggctgg ttatctagaa
4501 gaaaacgcat tgaatttctg gattcttcta aactctctaa aaaagaaatt ctatatctaa
4561 ataagagcg ctttgaagaa ataactaaga aatctaaaga acaaatggaa caattagaac
4621 aagaatctat taattaatag caagcttgaa actaaaaacc taatttattt aaagctcaaa
4681 ataaaaaga gttttaaaat gggaaattct ggttttttatt tgtataacac tgaaaactgc
4741 gtctttgctg ataatatcaa agttgggcaa atgacagagc cgctcaagga ccagcaaata
4801 atccttggga caacatcaac acctgtcgca gcaaaatga cagcttctga tggaatatct
4861 ttaacagtct ccaataattc atcaaccaat gcttctatta caattggttt ggatgcggaa
```

FIG. 20A (cont.)

```
4921 aagcttacc agcttattct agaaaagttg ggagatcaaa ttcttgatgg aattgctgat
4981 actattgttg atagtacagt ccaagatatt ttagacaaga tcaaaacaga cccttctcta
5041 ggtttgttga aagcttttaa caacttccca atcactaata aaattcaatg caacgggtta
5101 ttcactccca gtaacattga aacttattta ggaggaactg aaataggaaa attcacagtc
5161 acacccaaaa gctctggag catgttctta gtctcagcag atattattgc atcaagaatg
5221 gaaggcggcg ttgttctagc tttggtacga gaaggtgatt ctaagccctg cgcgattagt
5281 tatggatact catcaggcat tcctaattta tgtagtctaa gaaccagtat tactaataca
5341 ggattgactc cgacaacgta ttcattacgt gtaggcggtt tagaaagcgg tgtggtatgg
5401 gttaatgccc tttctaattg caatgatatt ttaggaataa caatactttc taatgtatct
5461 tttttagagg taatacctca aacaaacgct taaacaattt ttattggatt tttcttatag
5521 gtttatatt tagagaaaac agttcgaatt ttatgcaaaa tatgcaaaa taaaagaaaa
5581 gtgaggacg atttattaa aattgttaaa gatgtgaaaa aagatttccc cgaattagac
5641 ctaaaaatac gagtaaacaa ggaaaaagta acttccttaa attctcccctt agaactctac
5701 cataaaagtg tctcactaat tctaggactg cttcaacaaa tagaaaactc tttaggatta
5761 ttcccagact ctcctgttct gaggataaca gttaaagct gttaaaggct aaaaaaggct
5821 ttgattatgc ttatcttgtc atgttttcca aggctgaata gacaacttac
5881 tctaacgttg gagttgattt gcacaccttaa gttttttgct cttttaaggg aggaactgga
5941 aaaacaacac tttctctaaa cgtgggatgc aacttggccc aattttaagg gaaaaaagtg
6001 ttacttgctg acctagaccc gcaatccaat ttatcttctg gattgggggc tagtgtcaga
6061 agtgaccaaa aaggcttgca cgacatagta tacacatcaa acgatttaaa atcaatcatt
6121 tgcgaaacaa aaaagatag tgtggaccta attcctgcat cattttcatc cgaacagttt
6181 agagaattgg atattcatag aggacctagt aacaacttac agttatttct gaatgagtac
6241 tgcgctcctt ttatgacat ctgcataata gacactccac ctagcctagg agggttaacg
6301 aaagaagctt ttgtttgcagg agacaaatta attgcttgtt taactccaga acctttttct
6361 attctaggg tacaaaagat acgtgaattc ttaagttcgg tcggaaaacc tgaagaagaa
6421 cacattcttg gaatagcttt gtcttttttgg gatgatcgta actcgactaa ccaaatgtat
6481 atagacatta tcgagtctat ttacaaaaac aagcttttt caacaaaaat tcgtcgagat
```

FIG. 20A (cont.)

```
6541 atttctctca gccgttctct tcttaaagaa gattctgtag ctaatgtcta tccaaattct
6601 agggccgcag aagatattct gaagttaacg catgaaatag caaatatttt gcatatcgaa
6661 tatgaacgag attactctca gaggacaacg tgaacaaact aaaaaaagaa gcggatgtct
6721 tttttaaaaa aaatcaaact gccgcttctc tagatttaa gaagacgctt ccctccattg
6781 aactattctc agcaactttg aattctgagg aaagtcagag tttggatcga ttattttat
6841 cagagtccca aaactattcg gatgaagaat tttatcaaga agacatccta gcggtaaaac
6901 tgcttactgg tcagataaaa tccatacaga agcaacacgt acttcttta ggagaaaaaa
6961 tctataatgc tagaaaaatc ctgagtaagg atcacttctc ctcaacaact ttttcatctt
7021 ggatagagtt agttttataga actaagtctt ctgcttacaa tgctcttgca tattacgagc
7081 tttttataaa cctcccaac caaactctac aaaagagtt tcaatcgatc cctataaat
7141 ccgcatatat tttggccgct agaaaaggcg atttaaaaac caagtcgat gtgataggga
7201 aagtatgtgg aatgtcgaac tcatcggcga taagggtgtt ggatcaattt cttccttcat
7261 ctagaaacaa aggcgttaga gaaacgataga atacttcgca ttcagagaag aatcgccaat
7321 tatctgattt cttaatagag tacttcgca tcatgtgttc cggagttct ttgtcctcct
7381 ataacgaaaa tcttctacaa cagctttttg aacttttaa gcaaaagagc tgatcctccg
7441 tcagctcata tatatatat tattatatat atatattag ggattgatt tcacgagaga
7501 ga
```

FIG. 20B

Corresponding Amino Acid Sequence of Pgp1 (SEQ ID NO: 144):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 20C

Corresponding Amino Acid Sequence of Pgp2 (SEQ ID NO: 145):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKEFLEAYGVKRYKTSRNKYEFSGKEAETALEALYHLGHQPFLIVATRTRWTNGTQTVDRYQ
TLSPIIRIYEGWEGLTDEENIDIDLTPFNSPPTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 20D

Corresponding Amino Acid Sequence of Pgp3 (SEQ ID NO: 146):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 20E

Corresponding Amino Acid Sequence of Pgp4 (SEQ ID NO: 147):

MQNKRKVRDDFIKIVKDKKDFPELDLKIRVNKEKVTELNSPLELYHKSVSLIIGLLQQIENSLGLFPDSPVLEKLEDN
SLKLKKALIMLILSRKDMFSKAE

FIG. 20F

Corresponding Amino Acid Sequence of Pgp5 (SEQ ID NO: 148):

MHTLVFCSFKGGTGKTTLSLNVGCNLAQFLGKKVLLADLDPQSNLSSGLGASVRSDQKGLHDIVYTSNDLKSIICETKK
DSVDLIPASFSSEQFRELDIHRGPSNNLKLFLNEYCAPFYDICIIDTPPSLGGLTKEAFVAGDKLIACLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 20G

Corresponding Amino Acid Sequence of Pgp6 (SEQ ID NO: 149):

MNKLKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKGVRETIDKSDEKNRQLSDFLIEILRIMCSGVSLSSYNENLLQ
QLFELFKQKS

FIG. 20H

Corresponding Amino Acid Sequence of Pgp7 (SEQ ID NO: 150):

MGSMAFHKSRLFTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 20I

Corresponding Amino Acid Sequence of Pgp8 (SEQ ID NO: 151):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIITYPQKEMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKLALI

FIG. 21A

Nucleic Acid Sequence of Plasmid HE603234 (SEQ ID NO: 152):

```
   1 tttgcaactc ttggtggtag actttgcaac tcttggtggt agactttgca actcttggtg
  61 gtagactttg caactcttgg tggtagactt ggtcataatg gactttttgtt aaaaaatttc
 121 ttaaaatctt agagctccga tttgaatag ctttggttaa gaaaatgggc tcgatgcctt
 181 tccataaaag tagattgttt ttaacttttg gggacgcgtc ggaaattggg ttatctactt
 241 tatcttatct aactagaaaa aattatgcgt ctgggattaa cttcttgtt tctttagaga
 301 ttctggattt atcggaaacc ttgataaagg ctatttctct tgaccacagc gaatctttgt
 361 ttaaaatcaa gtctctagat gtttttaatg gaaaagttgt ttcagaggca tctaaacagg
 421 ctagagcggc atgctacata tctttcacaa agtttttgta tagattgacc aagggatata
 481 ttaaacccgc tattccattg aaagattttg gaaacactac atttttttaaa atccgagaca
 541 aaatcaaaac agaatcgatt tctaagcagg aatggacagt tttttttgaa gcgctccgga
 601 tagtgaatta tagagactat ttaatcggta aatgattgt acaaggatc cgtaagttag
 661 acgaaattt gtctttgcgc acagacgatc tattttttgc atccaatcag atttcctttc
 721 gcattaaaaa aagacagaat aaagaaacca aaattctaat cacatttcct atcagcttaa
 781 tggaagagtt gcaaaaatac acttgtggga gaaatgggag agtattttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttttgatt catttaaagc
 961 aaataggatt aaaagatgag gaaatcatgc gtattttcctg tcttttcatcg agacaaagtg
1021 tgtgttctta ttgttctggg gaagagttaa ttcctctagt tgccagaaaa acaaacaccc acaatattgt
1081 gatataatta aaattatatt catatctctgt tgccagaaaa aacaccttta ggctatatta
1141 gagccatctt ctttgaagcg ttgtcttctc gagaagattt atcgtacgca aatatcatct
1201 ttgcggttgc gtgtcctgtg accttcatta tgtcggagtc tgagcaccct aggcgtttgt
1261 actccgtcac agcggttgct cgaagcacgt gcgggttat tttaaaaggg attgcagctt
1321 gtagtcctgc gtgagagaac gtgcgggcga tttgccttaa cccaccatt tttccggagc
1381 gagttacgaa gacaaaacct cttcgttgac cgatgtactc ttgtagaaag tgcataaact
1441 tctgaggata agttataata atcctctttt ctgtctgacg gttcttaagc tgggagaaag
1501 aaatggtagc ttgtttgaaa caaatctgac taatctccaa gcttaagact tcagaggagc
1561 gttacctcc ttgagcatt gtctgggcga tcaaccaatc cgggcattg attttttta
```

FIG. 21A (cont.)

```
1621 gctcttttag gaaggatgct gtttgcaaac tgttcatcgc atccgttttt actatttccc
1681 tggttttaaa aaatgttcga ctattttctt gtttagaagg tttagcctata gcgactattc
1741 cttgagtcat cctgttttagg aatccttgtta aggaaatata gcttgctgct cgaacttgtt
1801 tagtaccttc ggtccaagaa gtcttggcag aggaaacttt tttaatcgca tctaggatta
1861 gattatgatt taaaagggaa aactccttgca gattcatatc caaggacaat agaccaatct
1921 tttctaaaga caaaaaagat cctcgatatg atctacaagt atgttttgttg agtgatgcgg
1981 tccaatgcat aataacttcg aataaggaga agctttcat gcgtttccaa taggattctt
2041 ggcgaattt taaaacttcc tgataagact tttcactata atttcttgct
2101 gcaaagataa aatcccttta cccatgtgat ctaacgac cgtaaaatgt
2161 cctgattagt gaaataatca ggtgttaac aggatagcac gctcggtatt tttttatata
2221 aacatgaaaa ctcgttccga aatagaaaat cgcatgcaag atatcgagta tgcgttgtta
2281 ggtaaagctc tgatatttga agactctact gagtatattc tgaggcagct tgctaattat
2341 gagtttaagt gttctcatca taaaaacata ttcatagtat ttaaatactt aaaagacaat
2401 ggattaccta taactgtaga ctcggcttgg gaagagcttt tgcggcgtcg tatcaaagat
2461 atgacaaat cgtatctcgg gttaatgttg catgatgctt tatcaaatga caagcttaga
2521 tccgttttctc atacggtttt cctcgatgat ttgagcgtgt gtagcgctga agaaaatttg
2581 agtaatttca ttttccgctc gtttaatgag tacaatgaaa atccattgcg tagatctccg
2641 tttctattgc ttgagcgtat aaagggaagg cttgatagtg ctatagcaaa gactttttct
2701 attcgcagcg ctagaaaaag gtcattttat gatatattct cacagtcaga aattggagtg
2761 ctggctcgta taaaaaacaa acgagtagcg ttctctgaga atcaaaattc tttctttgat
2821 ggcttcccaa caggatacaa ggatattgat gataaaggag ttatcttagc taaggtaat
2881 ttcgtgatta tagcagctag accatctata ctttagctat agacatggcg
2941 ataaatcttg cggttactca acagcgtaga gttggtttcc tatctctaga aatgagcgca
3001 ggtcaaattg ttgagcggat tattgcttaa ttaacaggaa tatctggtga aaaattacaa
3061 agaggggatc tctctaaaga agaattattc cgagtagaag aagctggaga aacggttaga
3121 gaatcacatt tttatatctg cagtgatagt cagtataagc ttaacttaat cgcgaatcag
3181 atccggttgc tgagaaaaga agatcgagta gacgtaatat ttatcgatta cttgcagttg
```

FIG. 21A (cont.)

```
3241 atcaactcat cggttggaga aaatcgtcaa aatgaaatag cagatatatc tagaacctta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gtttctctt cggtattaca tttcgatcca
3541 aaaattagta aattctccgc tattaaaaaa gtatggtaaa ttatagtaac tgccacttca
3601 tcaaaagtcc tatccacctt gaaaatcaga agtttgaag aagacctggt caatctatta
3661 agatatctcc caattggct caaaatggga agtttgaagt tataggtctt gatttctt
3721 catctcatta ccatgcatta gcagctatcc aaagattact gaccgcaacg aattacaagg
3781 ggaacacaaa agggttgtt ttatccagag aatcaaatag ttttcaattt gaaggatgga
3841 taccaagaat ccgtttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgttttaa tagtggcaac tagaactcga tggactaatg
4021 gaacacaaat agtagaccgt taccaaactc tttctccgat cattaggatt tacgaaggat
4081 gggaggttt aactgacgaa gaaaatatag atatagactt aacaccttt aattcaccac
4141 ctacacggaa acataaaggg ttcgttgtag agccatgtcc tatcttggta gatcaaatag
4201 aatcctactt tgtaatcaag cctgcaaatg tataccaaga aataaaaatg cgtttcccaa
4261 atgcatcaaa gtatgcttac acattttatcg actgggtgat tacagcagct gcgaaaaaga
4321 gacgaaaatt aactaaggat aatttcttgg cagaaaaact gttattaaac gttaacgtta
4381 aaagtcttgc atatattta aggatgaatc ggtacatctg tacaaggaac tggaaaaaaa
4441 tcgagttagc tatcgataaa tgtatagaaa tcgccattca gcttggctgg ttatctagaa
4501 gaaaacgcat ctttgaagaa aactctcta gattcttcta aaaagaaatt ctatatctaa
4561 ataagagcg ctttgaagaa atctaataaga aactaaaaac ctaatttatt caagaatcta
4621 ttaattaata gcaagcttga aactaaaaac ctaatttatt caagaatcta
4621 ttaattaata gcaagcttga tggttttat ttgtataaca ctgaaaactg cgtcttgct
4681 agttttaaaa tggaaaattc aatgaatgca ccgctcaagg accagcaaat aatccttggg
4741 gataatatca aagtttgggca aatgacagag acagcttctg atggaatatc tttaacagtc
4801 acaacatcaa caccctgtcgc agccaaaatg acagcttctg atggaatatc tttaacagtc
4861 tccaataatt catcaaccaa tgcttctatt acaattggtt tggatgcgga aaaagcttac
```

FIG. 21A (cont.)

```
4921  cagcttattc  tagaaaagtt  gggagatcaa  attcttgatg  gaattgctga  tactattgtt
4981  gatagtacag  tccaagatat  tttagacaaa  atcaaaacag  acccttctct  aggtttgttg
5041  aaagctttta  acaactttcc  aatcactaat  aaaattcaat  gcaacgggtt  attcactccc
5101  agtaacattg  aaactttatt  aggaggaact  gaaataggaa  aattcacagt  cacacccaaa
5161  agctctggga  gcatgttctt  agtctcagca  gatattattg  catcaagaat  ggaaggcggc
5221  gttgttctag  cttgtgtacg  agaaggtgat  tctaagccct  gcgcgattag  ttatggatac
5281  tcatcaggca  ttccctaattt  atgtagtcta  agaaccagta  ttactaatac  aggattgact
5341  ccgacaacgt  attcattacg  tgtaggcggt  gtgtgtatg  ggttaatgcc
5401  ctttctaatg  gcaatgatat  tttaggaata  acaaatactt  ctaatgtatc  tttttagag
5461  gtaatacctc  aaacaaacgc  ttaaacaatt  tttattggat  tttcttata  ggttttatat
5521  ttagagaaaa  cagttcgaat  tacggggttt  gttatgcaaa  ataaaagaaa  agtgagggac
5581  gattttatta  aaattgttaa  agatgtgaaa  aaagatttcc  ccgaattaga  cctaaaaata
5641  cgagtaaaca  aggaaaaagt  aactttctta  aatctctcct  tagaactcta  ccataaaagt
5701  gtctcactaa  ttctaggact  gctctcaacaa  atagaaaact  ctttaggatt  attcccagac
5761  tctcctgttc  ttgaaaaatt  agaggatacc  agtttaaagc  agtttaaagc  tttgattatg  ctctaacgtt
5821  cttatcttgt  ctagaaaaga  catgttttcc  aaggctgaat  agacaactta  aaaacaaca
5881  ggagttgatt  tgcacacctt  agttttttgc  tctttaagg  gaggaactgg  gttacttgct
5941  ctttctctaa  acgtgggatg  caacttggcc  caattttag  ggaaaaaagt  gttacttgct
6001  gacctagacc  cgcaatccaa  tttatcttct  ggattggggg  ctagtgtcag  aagtgaccaa
6061  aaaagcttgc  acgacatagt  atacacatca  aacgatttaa  aatcaatcat  ttgcgaaaca
6121  aaaaaagata  gtgtggacct  aattcctgca  tcattttcat  ccgaacagtt  tagagaattg
6181  gatattcata  gaggacctag  aagttattc  tgaatgagta  ctgcgctcct
6241  ttttatgaca  tctgcataat  cctagcctag  agacactcca  aattgcttgt  aaccttttc  gaaagaagct
6301  tttgttgcag  gagacaaatt  ttaactccag  ttaactccag  ttaactccag  ctgaagaaga  tattctaggg
6361  ttacaaaga  tacgtgaatt  cttaagttcg  gtcggaaaac  ctgaagaaga  acacattctt
6421  ggaatagctt  tgtctttttg  ggatgatcgt  aactcgacta  accaatgta  tatagacatt
6481  atcgagtcta  tttacaaaaa  caagcttttt  tcaacaaaaa  ttcgtcgaga  tatttctctc
```

FIG. 21A (cont.)

```
6541 agccgttctc ttcttaaaga agattctgta gctaatgtct atccaaattc tagggccgca
6601 gaagatattc tgaagttaac gcatgaaata gcaaatattt tgcatatcga atatgaacga
6661 gattactctc agaggacaac gtgaacaaac taaaaaaaga acggatgtc tttttaaaa
6721 aaaatcaaac tgccgcttct ctagatttta agaagacgct tccctccatt gaactattct
6781 cagcaacttt gaattctgag gaaagtcaga gtttggatcg attattttta tcagagtccc
6841 aaaactattc ggatgaagaa tttatcaag aagacatcct agcggtaaaa ctgcttactg
6901 gtcagataaa atccatacag aagcaacacg tacttcttt aggagaaaa atctataatg
6961 ctagaaaaat cctgagtaag gatcactct cctcaacaac ttttcatct tggatagagt
7021 tagttttag aactaagtct tctgcttaca atgctcttgc atattacgag cttttataa
7081 acctcccaa ccaaactcta caaaagagt ttcaatcgat ccctataaa tccgcatata
7141 tttggccgc tagaaaaggc gatttaaaaa ccaaggtcga tgtgataggg aaagtatgtg
7201 gaatgtcgaa ctcatcggcg ataagggtgt tggatcaatt tcttccttca tctagaaaca
7261 aagacgttag agaaaacgata gataagtctg attcagagaa gaatcgccaa ttatctgatt
7321 tcttaataga gatacttcgc atcatgtgtt ccggagtttc tttgtcctcc tataacgaaa
7381 atcttctaca acagctttt gaacttttta agcaaaagag ctgatcctcc gtcagctcat
7441 atatatatat ctattatata tatatattta gggatttgat ttcacgagag aga
```

FIG. 21B

Corresponding Amino Acid Sequence of Pgp1 (SEQ ID NO: 153):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRVAFSENQNSFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 21C

Corresponding Amino Acid Sequence of Pgp2 (SEQ ID NO: 154):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPPTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQESIN

FIG. 21D

Corresponding Amino Acid Sequence of Pgp3 (SEQ ID NO: 155):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDSTVQDILDKIKTDPSLGLLKAFNNFPITNKIQCNGLFTPSNIETLLGGTEIGKFTVTPKS
SGSMFLVSADIIASRMEGGVVLALVREGDSKPCAISYGYSSGIPNLCSLRTSITNTGLTPTTYSLRVGGLESGVVWVNA
LSNGNDILGITNTSNVSFLEVIPQTNA

FIG. 21E

Corresponding Amino Acid Sequence of Pgp4 (SEQ ID NO: 156):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 21F

Corresponding Amino Acid Sequence of Pgp5 (SEQ ID NO: 157):

MHTLVFCSFKGGTGKTTLSLNVGCNLAQFLGKKVLLADLDPQSNLSSGLGASVRSDQKGLHDIVYTSNDLKSIICETKK
DSVDLIPASFSSEQFRELDIHRGPSNNLKFLNEYCAPFYDICIIDTPPSLGGLTKEAFVAGDKLIACLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 21G

Corresponding Amino Acid Sequence of Pgp6 (SEQ ID NO: 158):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 21H

Corresponding Amino Acid Sequence of Pgp7 (SEQ ID NO: 159):

MGSMAFHKSRLFLTFGDASEIWLSTLSYLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVIPLVQTPTIL

FIG. 21I

Corresponding Amino Acid Sequence of Pgp8 (SEQ ID NO: 160):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKIRNARDWLIAQTMLQGGKRSSEVLSLEISQICFQQATISFSQLKNRQTEKRIITYPQKFMHFLQEY
IGQRRGFEVFVTRSGKMVGLRQIARTFSQAGLQAAIPFKITPHVLRATAVTEYKRLGCSDSDIMKVTGHATAKMIFAYDK
SSREDNASKKMALI

FIG. 22A

Nucleic Acid Sequence of Plasmid HE603235 (SEQ ID NO: 161):

```
   1 tttgcaactc ttggtggtag actttgcaac tcttggtggt agactttgca actcttggtg
  61 gtagacttgg tcataatgga cttttgttaa aaaattcttt aaaatcttag agctccgatt
 121 ttgaatagct ttggttaaga aatgggctc gatggcttc cataaaagta gattgttctt
 181 aactttggg gacgcgtcgg aaatttgtt atctacttta tctcatctaa ctagaaaaaa
 241 ttatgcgtct gggattaact ttcttgtttc tttagagatt ctgatttat cggaaaactt
 301 gataaaggct attctcttg accacagcga atctttgttt aaaatcaagt ctctagatgt
 361 ttttaatgga aaagtcgttt cagaggcctc taaacaggct agagcggcat gctacatatc
 421 tttcacaaag tttttgtata gattgaccaa gggatatatt aaacccgcta ttccattgaa
 481 agatttgga acactacat tttttaaaat ccgagacaaa atcaaaacag aatcgatttc
 541 taagcaggaa tggacagttt tttttgaagc gctccggata gtgaattata gagactattt
 601 aatcggtaaa ttgattgtac aagggatccg taagttagac gaaatttgt ctttgcgcac
 661 agacgatcta ttttttgcat ccaatcagat ttcctttcgc attaaaaaaa gacagaataa
 721 agaaaccaaa attctaatca cattcctat cagcttaatg gaagagttgc aaaaatacac
 781 ttgtgggaga aatgggagag tatttgtttc taaaatcagg attcctgtaa caacaagtca
 841 ggttgcgcat aatttaggc ttgcagagtt ccatagtgct atgaaaataa aaattactcc
 901 cagagtactt cgtgcaagcg ctttgattca tttaaagcaa ataggattaa aagatgagga
 961 aatcatgcgt cctcctgtc tctcatcgag acaaagtgtg tgttcttatt gttctgggga
1021 agaggtaagt ccctctagtac aaacacccac aatattgtga tataattaaa attatattca
1081 tattctgttg ccagaaaaaa cacctttagg ctatattaga gccatctct ttgaagcgtt
1141 gtcttctcga gaggatttat cgtacgcaaa tatcatcttt gcggttgcgt gtcccgtgac
1201 cttcattatg tcggagtctg agcaccctag gcgttgtac tccgtcacag cggttgctcg
1261 aagcacgtgc gggttatct taaaagggat tgcagcttgt agtcctgctt gagagaacgt
1321 gcgggcgatt tgccttaacc ccaccatttt tccggagcga gttacgaaga caaacctct
1381 tcgttgaccg atgtactctt gtagaaagtg cataaacttc tgaggataag ttataataat
1441 cctcttttct gtctgacggt tcttaagctg agagaaagaa atggtagctt gttgaaaca
1501 aatctgacta atctccaagc ttaagacttc agaggagcgt ttacctcctt ggagcattgt
1561 ctgggcgatc aaccaatccc gggcgttgat tcttttagc tcttttagga aggatgctgt
```

FIG. 22A (cont.)

```
1621 ttgcaaactg ttcatcgcat ccgtttttac tatttccctg gttttaaaaa atgttcgact
1681 attttcttgt ttagaaggtt gcgctatagc gactattcct tgagtcatcc tgtttaggaa
1741 tcttgttaag gaaatatagc ttgctgctcg aacttgttta gtaccttcgg tccaagaagt
1801 cttggcagag gaaacttttt taatcgcatc taggattaga ttatgattta aaagggaaaa
1861 ctcttgcaga ttcatatcca aagacaatag accaatcttt tctaaagaca aaaaagatcc
1921 tcgatatgat ctacaagtat gtttgttgag tgatgcggtc caatgcataa taacttcgaa
1981 taaggagaag cttttcatgc gtttccaata ggattcttgg cgaatttta aaacttcctg
2041 ataagacttt tcgctatatt ctaacgacat ttcttgctgc aaagataaaa tccctttacc
2101 catgaaatcc ctcgtgatat aacctatccg caaaatgtcc tgattagtga aataatcagg
2161 ttgttaacag gatagcacgc tcggtatttt tttatataaa catgaaaact cgttccgaaa
2221 tagaaaatcg catgcaagat atcgagtatg cgttgttagg taaagctctg atatttgaag
2281 actctactga gtatattctg aggcagcttg ctaattatga gtttaagtgt tcccatcata
2341 aaaacatatt catagtattt aaatacttaa aagacaatgg attacctata actgtagact
2401 cggcttggga agagcttttg cggcgtcgta tcaaagatat ggacaaatcg tatctcgggt
2461 taatgttgca tgatgcttta tcaaatgaca agcttagatc cgttctcat acggttttcc
2521 tcgatgattt gagcgtgtgt agcgctgaag aaaatttgag caatttcatt ttccgctcgt
2581 ttaatgagta caatgaaaat ccattgcgta gatctccgtt tctattgctt gagcgtataa
2641 agggaaggct tgatagtgct atagcaataa cagttcagag aggggcccgct agaggccggt
2701 ctatttatga tatattctca cagtcagaga ttgagtgct ggctcgtata aaaaaaaagac
2761 gagcagcgtt ctctgagaat caaaattctt tcttttgatgg cttcccaaca ggatacaagg
2821 atattgatga taaagaggtt atcttagcta aaggtaattt cgtgattata gcagctaggc
2881 catctatagg gaaaacagct ttagctatag acatggcgat aaatcttgcg gttactcaac
2941 agcgtagagt tggttttccta tctctagaaa tgagcgcagg tcaaattgtt gagcggattg
3001 ttgctaattt aacaggaata tctggtgaaa aattacaaag agggatctc tctaaagaag
3061 aattattccg agtggaagaa gctggagaga cagttagaga atcacatttt tatatctgca
3121 gtgatagtca gtataagctt aatttaatcg cgaatcagat ccggttgctg agaaagaaag
3181 atcgagtaga cgtaatattt atcgattact tgcagttgat caactcatcg gttggagaaa
```

FIG. 22A (cont.)

```
3241 atcgtcaaaa tgaaatagca gatatatcta gaacctta ag aggtttagcc tcagagctaa
3301 acattcctat agtttgttta tcccaactat ctagaaaagt tgaggataga gcaaataaag
3361 ttcccatgct ttcagatttg cgagacagcg gtcaaatag a gcaagacgca gatgtgatt
3421 tgtttatcaa taggaaggaa tcgtcttcta attgtgagat aactgttggg aaaaatagac
3481 atggatcggt ttctctttcg gtattacatt tcgatccaaa aattagtaaa ttctccgcta
3541 ttaaaaaagt atggtaaatt atagtaactg ccacttcatc aaaagtccta tccaccttga
3601 aaatcagaag tttggaagaa gacctggtca atctattaag atatctccca aattgctca
3661 aaatgggatg gtagaagtta taggtcttga tttctttca tctcattacc atgcattagc
3721 agctatccaa agattactga ccgcaacgaa ttacaagggg aacacaaaag gggttgttt
3781 atccagagaa tcaaatagtt ttcaatttga aggatgata ccaagaatcc gtttacaaa
3841 aactgaattc ttagaggctt atggagttaa gcggtataaa acatccagaa ataagtatga
3901 gtttagtgga aaagaagctg aaactgcttt agaagccttg taccatttag gacatcaacc
3961 gttttttaata gtggcaacta gaactcgatg gactaatgga acacaaaatag tagaccgtta
4021 ccaaactctt tctccgatca ttaggattta cgaaggatgg gaaggtttaa ctgacgaaga
4081 aaatatagat atagacttaa caccttttaa ttcaccatct acacggaaac ataaaggatt
4141 cgttgtagag ccatgtccta tcttggtaga tcaaatagaa tcctactttg taatcaagcc
4201 tgcaaatgta taccaagaaa taaaaatgcg tttcccaaac gcatcaaagt atgcttacac
4261 atttatcgac tgggtgatta cagcagctgc gaaaaagaga cgaaaattaa ctaaggataa
4321 ttcttggcca gaaaacttgt tattaaacgt taacgttaaa agtcttgcat atatttaag
4381 gatgaatcgg tacatctgta caaggaactg tataaaaatc gagttagcta tcgataaatg
4441 tatagaaatc gccattcagc ttggctggtt atctagaaga aaacgcattg aatttctgga
4501 ttcttctaaa ctctctaaaa aagaaattct atatctaaat aattaatagc ttgaagaaat
4561 aactaagaaa tctaagaaac aaatgaaca agaatctatt ttttaaaatg aggcttgaaa
4621 ctaaaaacct aatttattta aagctcaaaa tctttgctga taatcaaa gttggcaaa
4681 gtttttattt gtataacact gaaaactgcg tcctttggac aaaatcaaca cctgtcgcag
4741 tgacagagcc gctcaaggac cagcaaataa taacagtctc taacagttctt tcaccaatg
4801 ccaaatgac agcttctgat ggaatatctt taacagtctc caataattca tcaccaatg
4861 cttctattac aattggtttg gatgcggaaa aagcttacca gctattcta gaaaagttgg
```

FIG. 22A (cont.)

```
4921 gaaatcaaat tcttgatgga attgctgata ctattgttga tagtacagtc caagatattt
4981 tagacaaaat cacaacagac ccttctctag gtttgtttgaa agctttaac aactttccaa
5041 tcactaataa aattcaatgc aacgggttat tcactcccag taacattgaa actttattag
5101 gaggaactga aataggaaaa ttcacagtca cacccaaaag ctctgggagc atgttcttag
5161 tctcagcaga tattattgca tcaagaatgg aaggcggcgt tgttctagct ttggtacgag
5221 aaggtgattc taagccctgc gcgattagtt atggatactc atcaggcgtt cctaatttat
5281 gtagtctaag aaccagcatt actaatacag gattgactcc aacaacgtat tcattacgtg
5341 taggcggttt agaaagcggt gtggtatggg ttaatgccct ttctaatggc aatgatattt
5401 taggaataac aaatacttct aatgtatctt tttggaagt aatacctcaa acaaacgctt
5461 aaacaattt tattggattt ttcttatagg aaagaaaag tttatattt agagaaaaca gttcgaatta
5521 cgggtttgt tatgcaaaat aaacaacttact tgaggacga tttattaaa attgttaaag
5581 atgtgaaaaa agatttcccc gaattagacc taaaaatacg agtaaacaag gaaaagtaa
5641 ctttcttaaa ttctccctta gaactctacc ataaaagtgt ctcactaatt ctaggactgc
5701 ttcaacaaat agaaactct ttaggattat tcccagactc tcctgttctt gaaaaattag
5761 aggataacag tttaagcta aaaagcgtt tgattatgct tatcttgtct agaaaagaca
5821 tgttttccaa ggctgaatag acaacttact ctaacgttgg agttgattg cacaccttag
5881 tttttgctc tttaaggga ggaactgaa aaacaacact ttctctaaac gtggatgca
5941 acttggccca atttttaggg aaaaaaagtgt tacttgctga cctagaccg caatccaatt
6001 tatcttctgg attggggct agtgtcagaa ataaccaaaa aggcttgcac gacatagtat
6061 acaatcaaa cgatttaaaa tcaatcattt gcgaaacaaa aaaagatagt gtggacctaa
6121 ttcctgcatc attttatc gaacagttta gagaattgga tattcataga ggacctagta
6181 acaacttaaa gttattctg aatgagtact gcgctcctt tcgcataatc tgcataatag
6241 acactccacc tagcctagga gggttaacga aagaagcttt tgttgcagga gacaaattaa
6301 ttgcttgttt aactccagaa ccctttttcta ttctaggggtt acaaagata cgtgaattct
6361 taagttcggt cggaaaacct gaagaagaac acattcttgg aatagcttg tcttttggg
6421 atgatcgtaa ctcgactaac caaatgtata tagacattat cgagtctatt tacaaaaaca
6481 agcttttttc aacaaaaatt cgtcgagata tttctctcag ccgttctctt cttaaagaag
6541 attctgtagc taatgtctat ccaaattcta gggccgcaga agatattctg aagttaacgc
```

FIG. 22A (cont.)

```
6601 atgaaatagc aaatattttg catatcgaat atgaacgaga ttactctcag aggacaacgt
6661 gaacaaacta aaaaaagaag cggatgtctt tttaaaaaa aatcaaactg ccgcttctct
6721 agattttaag aagacacttc cttccattga actattctca gcaactttga attctgagga
6781 aagtcagagt ttgatcgat tattttatc agagtcccaa aactattcgg atgaagaatt
6841 ttatcaagaa gacatcctag cggtaaaact gcttactggt cagataaaat ccatacagaa
6901 gcaacacgta cttcttttag ctatcatgct ctataatgct agaaaatcc tgagtaagga
6961 tcacttctcc tcaacaactt tttcatcttg gatagagtta gttttagaa ctaagtcttc
7021 tgcttacaat gctccttgcat attacgagct tttataaac ctcccaacc aaactctaca
7081 aaaagagttt caatcgatcc cctataaatc cgcatatatt ttggccgcta gaaaaggcga
7141 tttaaaaacc aaggtcgatg tgataggaa agtatgtgga atgtcgaact catcggcgat
7201 aagggtgttg gatcaatttc ttccttcatc tagaaacaaa gacgttagag aaacgataga
7261 taagtctgat ttagagaaga atcgccaatt atctgatttc taatagaga tacttcgcat
7321 catatgttcc ggagtttctt tgtcctccta aacgaaaat cttctacaac agctttttga
7381 acttttaag caaaagagct gatcctccgt cagctcatat atatatttat tataatata
7441 tttatttagg gattgattt tacgagagag a
```

FIG. 22B

Corresponding Amino Acid Sequence of Pgp1 (SEQ ID NO: 162):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVIIAARPSIGKTALAID
MAINLAVTQQRRVGFLSLEMSAGQIVERIVANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 22C

Corresponding Amino Acid Sequence of Pgp2 (SEQ ID NO: 163):

MVNYSNCHFIKSPIHLENQKFGRRPGQSIKISPKLAQNGMVEVIGLDFLSSHYHALAAIQRLLTANYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQE-KMRFPNASKYAYT
FIDWVITAAAKKRRKLTKDNSWPENLLLNVNVKSLAYILRMNRYICTRNWKKIEIAIDKCIEIAIQLGWLSRRKRIEFL
DSSKLSKKEILY-NKERFEEITKKSKEQMEQESIN

FIG. 22D

Corresponding Amino Acid Sequence of Pgp3 (SEQ ID NO: 164):

MGNSGEYLYNTENCVFADNIKVGQMTEPLKDQQIILGTKSTPVAAKMTASDGISLTVSNNSSTNASITIGLDAEKAYQL
ILEKLGNQILDGIADTIVDSTVQDILDKITTDPSLGLLKAFNNFPITNKIQCNGLFTPSNIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 22E

Corresponding Amino Acid Sequence of Pgp4 (SEQ ID NO: 165):

MQNKRKVRDDFIKIVKDVKKDFPELDLKIRVNKEKVTFLNSPLELYHKSVSLILGLLQQIENSLGLFPDSPVLEKLEDN
SLKLKKALIMLILSRKDMFSKAE

FIG. 22F

Corresponding Amino Acid Sequence of Pgp5 (SEQ ID NO: 166):

MHTLVECSFKGGTGKTTLSLNVGCNLAQFLGKKVLLADLDPQSNLSSGLGASVRNNQKGLHDIVYKSNDLKSIICETKK
DSVDLIPASFLSEQFRELDIHRGPSNNLKLFLNEYCAPFYDICIIDTPPSLGLTKEAFVAGDKL-ACLTPEPFSILGL
QKIREELSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 22G

Corresponding Amino Acid Sequence of Pgp6 (SEQ ID NO: 167):

MNKLKKEADVFFKKNQTAASLDFKKTLPSIELFSATLNSEESQSLDRLFLSESQNYSDEEFYQEDILAVKLLTGQIKSI
QKQHVLLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDLEKNRQLSDFLIEILRIICSGVSLSSYNENLLQ
QLFEJFKQKS

FIG. 22H

Corresponding Amino Acid Sequence of Pgp7 (SEQ ID NO: 168):

MGSMAFHKSRIFLTFGDASEIWLSTLSHLTRKNYASGINFLVSLEILDLSETLIKAISLDHSESLFKIKSLDVFNGKVV
SEASKQARAACYISFTKFLYRLTKGVIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 22I

Corresponding Amino Acid Sequence of Pgp8 (SEQ ID NO: 169):

MGKGILSLQQEMSLEYSEKSYQEVLKIRQESYWKRMKSFSLFEVIMHWTASLNKHTCRSYRGSFLSLEKIGLLSLDMNL
QEFSLNHNLILDAIKKVSSAKTSW-EGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 23A

Nucleic Acid Sequence of Plasmid HE603236 (SEQ ID NO: 170):

```
   1 tttgcaactc ttggtggtag actttgcaac tcttggtggt agactttgca actcttggtg
  61 gtagactttg caactcttgg tggtagactt ggtcataatg gacttttgtt aaaaatttc
 121 ttaaaatctt agagctccga ttttgaatag cttggttaa gaaaatgggc tcgatgctt
 181 tccataaaag tagattgttc ttaacttttg gggacgcgtc ggaaatttgg ttatctactt
 241 tatctcatct aactagaaaa aattatgcgt ctggattaa cttcctgtt tctttagaga
 301 ttctggattt atcagaaacc ttgataaagg ctatttctct tgaccacagc gaatctttgt
 361 ttaaaatcaa gtctctagat gttttttaatg gaaaagtcgt ttcagaggcc tctaaacagg
 421 ctagagcggc atgctacata tctttcacaa agttttttgta tagattgacc aagggatata
 481 ttaaacccgc tattccattg aaagattttg gaaacactac attttttaa atccgagaca
 541 aaatcaaaac agaatcgatt tctaagcagg aatgacagt tttttttgaa gcgctccgga
 601 tagtgaatta tagagactat ttaatcggta acaaggatc acaaggatc cgtaagttag
 661 acgaaatttt gtcttttgcgc acagacgatc tattttttgc atccaatcag atttccttc
 721 gcattaaaaa aagacagaat aaagaaacca aaattctaat cacattcct atcagcttaa
 781 tggaagagtt gcaaaaatac acttgtggga gaaatgggag aatattttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttttgat cattaaagc
 961 aaataggatt aaaagatgag gaaatcatgc gtatttcctg tctttcatcg agacaaagtg
1021 tgtgttctta ttgttctggg gaagaggtaa gtcctctagt acaaacaccc acaatattgt
1081 gatataatta aattatatt catattctgt tgccagaaaa aacaccttta ggctatatta
1141 gagccgtctt ctttgaagcg ttgtcttctc gagaagattt atcgtacgca aatatcatct
1201 ttgcggttgc gtgtcctgtg acctttcatta tgtcggagtc tgagcaccct aggcgttgt
1261 actccgtcac agcggtttgct cgaagcacgt gcggggtat cttaaaaggg attgcagctt
1321 gtagtcctgc ttgagagaac gtgcggcga tttgccttaa cccaccatt tttccgagc
1381 gagttacgaa gacaaaacct cttcgttgac cgatgtactc ttgtagaaag tgcataaact
1441 tctgaggata agttataata atccctcttt ctgtctgacg gttcttaagc tgggagaaag
1501 aaatggtagc ttgtttggaaa caaatctgac taatctccaa gcttaagact tcagaggagc
1561 gtttgcctcc ttggagcatt gtctgggcga tcaaccaatc cgggcattg ccggatc atttttttta
```

FIG. 23A (cont.)

```
1621 gctcttttag gaaggatgct gtttgcaaac tgttcatcgc atccgttttt actatttccc
1681 tggttttaaa aaatgttcga ctattttctt gtttagaagg ttgcgctata gcgactattc
1741 cttgagtcat cctgtttagg aatcttgtta aggaaatata gcttgctgct cgaacttgtt
1801 tagtaccttc ggtccaggaa gtcttggcag aggaaacttt tttaatcgca tctaggatta
1861 gattatgatt taaaagggaa aactcttgca gattcatatc caaggacaat agaccaatct
1921 tttctaaaga caaaaaagat cctcgatatg atctacacagt atgttttgttg agtgatgcgg
1981 tccaatgcat aataacttcg aataaggaga agctttcat gcgtttccaa taggattctt
2041 ggcgaatttt taaaacttcc tgataagact tttcgctata ttctaacgac atttcttgct
2101 gcaaagataa aatcccttta cccatgaaat ataacctatc cgtaaaatgt
2161 cctgattatt tcactaatca ggttgttaac aggatagcac gctcggtatt tttttatata
2221 aacatgaaaa ctcgttccga aatagaaaat cgcatgcaag atatcgagta tgcgttgtta
2281 ggtaaagctc tgatatttga agactctact gagtatattc tgagcagct tgctaattat
2341 gagtttaagt gttctcatca taaaaacata ttcatagtat ttaaatactt aaaagacaat
2401 ggattaccta taactgtaga ctcggtgtaa ctcggcttgg gaagagcttt tgcgcgtcg tatcaaagat
2461 atggacaaat cgtatctcgg gttaatgttg catgatgctt tatcaaatga caagcttaga
2521 tccgtttctc atacggtttt cctcgatgat ttgagcgtgt gtagcgctga agaaaatttg
2581 agtaatttca tttccgctc gttaatgag tacaatgaaa atccattgcg tagatctccg
2641 tttctattgc ttgagcgtat aaagggaagg gtctattttat gatatagtg ctatacaaa gacttttct
2701 attcgcagcg ctagaggccg acgagcagcg ttctctgaga cacagtcaga aattggagtg
2761 ctgctcgta taaaaaaag caggatacaa ggatattgat atcaaaattc ttcttagc taaaggtaat
2821 ggcttcccaa caggatacaa tagcagctag gccatctata cttagctat agacatggcg
2881 ttcgtgatta tagcagctag cggttactca acagcgtaga gttggtttcc tatctctaga aatgagcgca
2941 ataaatcttg cggttactca acagcgtaga gttggtttcc tatctctaga aatgagcgca
3001 ggtcaaattg ttgagcggat tattgctaat ttaacaggaa gttggtgtga aaaattacaa
3061 agagggatc tctctaaaga tttatatctg agaattattc cgagtggaag aacagttaga
3121 gaatcacatt cagtgatagt cagtataagc ttaattaat cgcgaatcag
3181 atccggttgc tgagaaaaga agatcgagta gacgtaatat ttatcgatta cttgcagttg
```

FIG. 23A (cont.)

```
3241 atcaactcat cggttggaga aaatcgtcaa aatgaaatag cagatatatc tagaacctta
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgttatc aataggaagg aatcgtcttc taattgtgag
3481 ataactgttg acatggatcg gttttctctt cggtattaca tttcgatcca
3541 aaaattagta aattctccgc tattaaaaaa gtatggtaaa tgccacttca
3601 tcaaagtcc tatccacctt gaaaatcaga agttggaag aagacctggt caatctatta
3661 agatatctcc caaattggct cagctatcc agttggaagt tataagtctt gatttctttt
3721 catctcatta ccatgcatta gcagctatcc aaagattact gactgcaacg aattacaagg
3781 ggaacacaaa aggggttgtt ttatccagag aatcaaatag tttcaattt gaaggatgga
3841 taccaagaat ccgttttaca aaaactgaat tcttagaggc ttatggagtt aagcggtata
3901 aaacatccag aaataagtat gagttttagtg gaaagaagc tgaaactgct ttagaagcct
3961 tgtaccattt aggacatcaa ccgttttttaa tagtgcaac tagaactcga tggactaatg
4021 gaacacaaat agtagaccgt taccaaactc tttctccgat cattaggatt tacgaaggat
4081 gggaaggttt aactgacgaa gaaaatatag atatagactt aacaccttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgtttcccaa
4261 acgcatcaaa gtatgcttac acatttatcg actgggtgat tacagcagct gcgaaaaaga
4321 gacgaaaatt aactaaggat aattcttggc cagaaaactt gttattaaac gttaacgtta
4381 aaagtcttgc atatattta aggatgaatc ggtacatctg ggtcccattca tggaaaaaaa
4441 tcgagttagc tatcgataaa tgtatagaaa tcgccattca gcttggctgg ttatctagaa
4501 gaaaacgcat tgaatttctg gattcttcta aactctctaa aaaagaaatt ctatatctaa
4561 ataagagacg ctttgaagaa ataactaaga atctaaaaga acaaatggaa caattagaac
4621 aataatctat taattaatag caggccttgaa actaaaaacc taatttattt aaagctcaaa
4681 ataaaaaaga gtttttaaaat gggaaattct ggttttttatt tgtataacac tgaaaactgc
4741 gtctttgctg atatatcaa agttgggcaa atgacagagc cgctcaagga ccagcaaata
4801 atccttggga caacatcaac acctgtcgca gccaaaatga cagcttctga tggaatatct
4861 ttaacagtct ccaataattc atcaaccaat gcttctatta caattgtt ggatgcggaa
```

FIG. 23A (cont.)

```
4921 aagcttacc agcttattct agaaaagttg ggaaatcaaa ttcttgatgg aattgctgat
4981 actattgttg atagtacagt ccaagatatt ttagacaaga tcacaacaga cccttctcta
5041 ggtttgttga aagcttttaa caacttttcca atcactaata aaattcaatg caacgggtta
5101 ttcactccca gtaacattga aactttatta ggaggaactg aaataggaaa attcacagtc
5161 acacccaaaa gctctggag catgttctta gtctcagcag atattattgc atcaagaatg
5221 gaaggcagcg ttgttctagc tttggtacga gaaggtgatt ctaagccctg cgcgattagt
5281 tatggatact catcaggcgt tcctaattta tgtagtctaa gaaccagcat tactaataca
5341 ggattgactc cgacaacgta ttcattacgt gtaggcggtt tagaaagcgg tgtggtatgg
5401 gttaatgccc tttctaatgg caatgatatt ttaggaataa caaatacttc taatgtatct
5461 tttttggagg taatacctca aacaaacgct acgggtttg ttattggatt tttcttatag
5521 gtttatatt tagagaaaac agttcgaatt gatgtgaaaa aagatttccc taaaagaaaa
5581 gtgagggacg atttattaa aattgttaaa actttcttaa actctccctt cgaattagac
5641 ctaaaaatac gagtaaacaa ggaaaaagta cttcaacaaa tagaaaactc tttaggatta
5701 cataaaagtg tctcactaat tctagggact gaggataaca gttttctcca aaaaaaggct
5761 ttcccagact ctcctgttct tagaaaagac atgtttttcca aggctgaata gacaacttac
5821 ttgattatgc ttatcttgtc tagaaaaatta gtttttttgct gttttttagg gggaactgga
5881 tctaacgttg gagttgattt gcacaccttga aacttggccc ctttttaaggg gaaaaaagtg
5941 aaaacaacac tttctctaaa cgtgggatgc aacttggccc aattttttagg tagtgtcaga
6001 ttacttgctg acctagaccc acaatccaat ttatcttctg gattggggc atcaatcatt
6061 agtaaccaaa aaggcttgca cgacatagta tacacatcaa acgatttaaa tgaacagttt
6121 tgcgaaacaa aaaagatag tgtggaccta attcctgcat catttttatc gaatgagtac
6181 agagaattgg atattcatag aggacctagt aacaacttaa agttctttct agggttaacg
6241 tgcgtccctt tttatgacat ctgcataata gacactccac ctagcctagg acctttttct
6301 aaagaagctt ttgttgcagg agacaaatta attgcttgtt taactccaga tcgggaaaac
6361 attctagggt tacaaaagat acgtgaattc ttaagttcgg tcggaaaacc tgaagaagaa
6421 cacattcttg gaatagcttt gtcttttgg gatgatcgta actcgactaa ccaaatgtat
6481 atagacatta tcgagtctat ttacaaaaac aagcttttt caacaaaaat tcgtcgagat
```

FIG. 23A (cont.)

```
6541 atttctctta gccgttctct tcttaaagaa gattctgtag ctaatgtcta tccaaattct
6601 agggccgcag aagatattct gaagttaacg catgaaatag caaatatttt gcatatcgaa
6661 tatgaacgag attactctca gaggacaacg tgaacaaact aaaaaaagaa gcggatgttt
6721 tttttaaaaa aaatcaaact gccgcttctc tagattttaa gaagacactt ccttccattg
6781 aactattctc agcaactttg aattctgagg aaagtcagag tttggatcga ttatttttgt
6841 cagagtccca aaactattcg gatgaagaat tttatcaaga agacatccta gcggtaaaac
6901 tgcttactgg tcagataaaa tccatacaga agcaacacgt acttctttta ggagaaaaaa
6961 tctataatgc tagaaaaatc ctgagtaagg atcacttctc ctcgacaact ttttcatctt
7021 ggatagagtt agttttttaga actaagtctt ctgcttacaa tgctcttgca tattacgagc
7081 tttttataaa cctcccaac caaactctac aaaaagagtt tcaatcgatc ccctataaat
7141 ccgcatatat tttggccgct agaaaaggcg atttaaaaac caagtcgat gtgatagga
7201 aagtatgtgg aatgtcgaac tcatcggcga atttaagggtgtt ggatcaattt cttccttcat
7261 ctagaaacaa agacgttaga atacttcgca tcagagaag ttcagagaag aatcgccaat
7321 tatctgattt cttaatagag atacttcgca tcatcgttgtc cggagtttct ttgtcctcct
7381 ataacgaaaa tcttctacaa cagcttttg aactttttaa gcaaaagagc tgatcctccg
7441 tcagctcata tatatatcta ttatatat atatttaggg atttgatttt acgagagagc
```

FIG. 23B

Corresponding Amino Acid Sequence of Pgp1 (SEQ ID NO: 171):

MKTRSEIENRMQDIEYALLGKALIFEDSTEYILRQLANYEFKCSHHKNIFIVEKYLKDNGLPITVDSAWEELLRRRIKD
MDKSYLGIMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 23C

Corresponding Amino Acid Sequence of Pgp2 (SEQ ID NO: 172):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAKKRRKLTKDNSWPENLLLNVNVKSLAYILRMNRYICTRNWKKIELAIDKCIEIAIQLGWLSRKKRIEFL
DSSKLSKKEILYLNKERFEEITKKSKEQMEQLEQ

FIG. 23D

Corresponding Amino Acid Sequence of Pgp3 (SEQ ID NO: 173):

MGNSGFYLYNTENCVFADNIKVGQMTEPLKDQQIILGTTSTPVAAKMTASDGISLTVSNNSSTNASITIGLDAEKAYQL
ILEKLGNQILDGIADTIVDSTVQDILDKITTDPSLGLLKAFNNFPITNKIQCNGLFTPSNIETLLGGTEIGKFTVTPKS
SGSMFLVSADIIASRMEGSVVLALVREGDSKPCAISYGYSSGVPNLCSLRTSITNTGLTPTTYSLRVGGLESGVVWVNA
LSNGNDILGITNTSNVSFLEVIPQTNA

FIG. 23E

Corresponding Amino Acid Sequence of Pgp4 (SEQ ID NO: 174):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 23F

Corresponding Amino Acid Sequence of Pgp5 (SEQ ID NO: 175):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKLFLNEYCAPFYDICIIDTPPSLGGLTKEAFVAGDKLIACLTPEPFSILGL
QKIREFLSSVGKPEEHIIGIALSFWDDRNSTNQMYIDIIESIYKNKLFSTKIRRDISLSRSLLKEDSVANVYPNSRAA
EDIILKLTHEIANILHIEYERDYSQRTT

FIG. 23G

Corresponding Amino Acid Sequence of Pgp6 (SEQ ID NO: 176):

MNKLKKEADVFKKNQTAASLDFKKTLPSIELFSATLNSEESQSLDRLFLSESQNYSDEEFYQEDILAVKLLTGQIKSI
QKQHVLLLGEKIYNARKILSKDHFSSTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 23H

Corresponding Amino Acid Sequence of Pgp7 (SEQ ID NO: 177):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRIFVSKIGIPVTTSQVAHN
FRLAEFHSAMKIKITPRVLRASALIHLKQIGLKDEEIMRISCLSSRQSVCSYCSGEEVSPLVQTPTIL

FIG. 23I

Corresponding Amino Acid Sequence of Pgp8 (SEQ ID NO: 178):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELFKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKTALI

FIG. 24A

Nucleic Acid Sequence of Plasmid HE603238 (SEQ ID NO: 179):

```
   1 tttgcaactc ttggtggtag actttgcaac tcttggtggt agactttgca actcttggtg
  61 gtagactttg caactcttgg tggtagactt ggtcataatg gactttgtt aaaaatttc
 121 ttaaaatctt agagctccga tttgaatag ctttgttaa gaaaatgggc tcgatggctt
 181 tccataaaag tagattgttc ttaacttttg gggacgcgtc ggaaatttgg ttatctactt
 241 tatctcatct aactagaaaa aattatgcgt ctgggattaa cttcctgtt tctttagaga
 301 ttctggattt atcggaaacc ttgataaagg ctattctct tgaccacagc gaatctttgt
 361 ttaaatcaa gtctctagat gttttttaatg gaaaagtcgt ttcagaggcc tctaaacagg
 421 ctagagcggc atgctacata tcttcacaa agttttgta tagattgacc aagggatata
 481 ttaaacccgc tattccattg aaagatttg gaaacactac attttttaaa atccgagaca
 541 aaatcaaaac agaatcgatt tctaagcagg aatggacagt tttttttgaa gcgctccgga
 601 tagtgaatta tagagactat ttaatcggta gaaacattgt acaaggatc cgtaagttag
 661 acgaaattt gtctttgcgc acagacgatc tatttttgc atccaatcag atttcctttc
 721 gcattaaaaa aagacagaat aaagaaacca aaattctaat cacatttcct atcagcttaa
 781 tggaagagtt gcaaaaatac actgtgggga gaaatgggag agtatttgtt tctaaaatag
 841 ggattcctgt aacaacaagt caggttgcgc ataattttag gcttgcagag ttccatagtg
 901 ctatgaaaat tagtccgtg cccagagtac ttcgtgcaag tgtcggagtc cgctttgatt catttaaagc
 961 aaataggatt aaaagatgag gaaatcatgc gtattccctg tctctcatcg agacaaagtg
1021 tgtgttctta ttgttctggg gaagaggtaa gtcctctagt tgccagaaaa acaaacaccc acaatattgt
1081 gatataatta aaattatatt catatctctgt tgccagaggat atcgtacgca aatatcatct
1141 gagccatctt cttgaagcg ttgtcttctc gagaggattt atcgtacgca aatatcatct
1201 ttgcggttgc gtgtccgtg acctttcatta tgtcggagtc tgagcaccct aggcgtttgt
1261 actccgtcac agcggttgct cgaagcacgt gcggggttat cttaaaaggg attgcagctt
1321 gtagtcctgc ttgagagaac gtgcgggcga tttgccttaa cccaccatt tttccggagc
1381 gagttacgaa gacaaaacct cttcgttgac cgatgtactc ttgtagaaag tgcataaact
1441 tctgaggata agttatataa atcctctttt ctgtctgacg gttcttaagc tgggagaaag
1501 aaatggtagc ttgtttggaa caaatctgac taatctccaa gcttaagact tcagaggagc
1561 gttacctcc ttggagcatt gtctgggcga tcaaccaatc ccgggcgttg atttttttta
```

FIG. 24A (cont.)

```
1621 gctcttttag gaaggatgct gtttgcaaac tgttcatcgc atccgttttt actatttccc
1681 tggttttaaa aaatgttcga ctattttctt gtttagaagg ttgcgctata gcgactattc
1741 cttgagtcat cctgtttagg aatcttgtta aggaaatata gctttgctgc cgaacttgtt
1801 tagtaccttc ggtccaagaa gtcttggcag aggaaacttt tttaatcgca tctaggatta
1861 gattatgatt taaaagggaa aactcttgca gattcatatc caaagacaat agaccaatct
1921 tttctaaaga caaaaaagat cctcgatatg atctacaagt atgtttgttg agtgatgcgg
1981 tccaatgcat aataacttcg aataaggaga agcttttcat gcgtttccaa taggattctt
2041 ggcgaatttt taaaacttcc tgataagact tttcgctata ttctaacgac atttcttgct
2101 gcaagataa aatcccttta cccatgaaat ataacctatc cgcaaaatgt
2161 cctgattagt ggttgttaac aggatagcac gctcggtatt tttttatata
2221 aacatgaaaa ctcgttccga aatagaaaat cgcatgcaag atatcgagta tgcgttgtta
2281 ggtaaagctc tgatatttga agactctact gagtatattc gagtcagct tgctaattat
2341 gagtttaagt gttcccatca taaaaacata ttcatagtat ttaaatactt aaaagacaat
2401 ggattaccta taactgtaga ctcggcttgg aagagcttt tgcggcgtcg tatcaagct
2461 atggacaaat cgtatctcgg gttaatgttg catgatgctt gtagcgctga gtagcgctga
2521 tccgttctc atacgtttt cctcgatgat gtttaatgag tacaatgaaa atccattgcg tagatccg
2581 agcaatttca tttccgctc aaagggaagg cttgatagtg ctatagcaaa gacttttct
2641 tttctattgc ttgagcgtat gtctatttat gatatattct cacagtcaga aattggagtg
2701 attcgcagcg ctagaggccg acgagcagcg ttctctgaga gataaaggag cttagctat tttctttgat
2761 ctggctcgta taaaaaaaag ggataccaa ggatattgat gggaaaacag cttagctat taaaggtaat
2821 ggcttcccaa caggatacaa ggccatctata gccatctata ggaaaacag agacatggcg
2881 ttcgtgatta tagcagctag cggttactca acagcgtaga gttggtttcc tatctctaga aatgagcgca
2941 ataatcttg cggttactca acagcgtaga tgttgctaat tatctggtga aaaattacaa
3001 ggtcaaattg ttgagcggat tgttgctaat agaattattc aagctggtga aacagttaga
3061 agagggatc tctctaaaga agaattattc cagtcgatagt ttaatttaat cgcgaatcag
3121 gaatcacatt tttatatctg cagtcgatagt cagtataagc ttaatttaat cttgcagttg
3181 atccggttgc tgagaaaaga agatcgagta dacgtaatat ttatcgatta tagaacctta
3241 atcaactcat cggttggaga aaatcgttcaa aatgaaatag cagatatatc
```

FIG. 24A (cont.)

```
3301 agaggtttag cctcagagct aaacattcct atagtttgtt tatccaact atctagaaaa
3361 gttgaggata gagcaaataa agttcccatg cttcagatt tgcgagacag cggtcaaata
3421 gagcaagacg cagatgtgat tttgttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccacctt gaaaatcaga agtttggaag aagacctggt caatctatta
3661 agatatctcc caaattggct caaatgggga agtttagaagt tataggtctt gattttcttt
3721 catctcatta ccatgctatc gcagctatcc aaagattact gaccgcaacg aattacaagg
3781 ggaacacaaa aggggtttgtt ttatccagag aatcaaatag ttttcaattt gaaggatgga
3841 taccaagaat ccgtttttaca aaaactgaat tcttagaggc ttatggagtt aagcggtata
3901 aaacatccag aaataagtat gagtttagtg gaaaagaagc tgaaactgct ttagaagcct
3961 tgtaccattt aggacatcaa ccgtttttaa tagtgcaac catctcgaa tggactaatg
4021 gaacacaaat agtagaccgt taccaaactc tttctccgat cattaggatt tacgaaggat
4081 gggaaggttt aactgacgaa gaaatatag atatagactt aacaccttt aattcaccat
4141 ctacacggaa acataaagga ttcgttgtag agccatgtcc tatcttggta gatcaaatag
4201 aatcctactt tgtaatcaag cctgcaaaga tataccaaga aataaaaatg cgttttcccaa
4261 acgcatcaaa gtatgcttac acatttatcg actgggtgat tacagcagct gcgaaaaaga
4321 gacgaaaatt aactaaggat aattcttggc cagaaaactt gttattaaac gttaacgtta
4381 aaagtcttgc atatattta aggatgaatc ggtacatctg tacaaggaac tggaaaaaaa
4441 tcgagttagc tatcgataaa tgtatagaaa tcgccattca gcttggctgg ttatctagaa
4501 gaaacgcat tgaatttctg gattcttcta aactctctaa aaaagaaatt ctatatctaa
4561 ataagagacg ctttgaagaa ataactaaga acaaatggaa caagaatcta
4621 ttaattaata gcaggcttga aactaaaaac ctaatttatt taagctcaa aataaaaaag
4681 agttttaaaa tgggaaattc tggttttat ttgtataaca ctgaaaactg cgtctttgct
4741 gataatatca aagttgggca aatgacagag ccgctcaagg accagcaaat aatccttggg
4801 acaaaatcaa cacctgtcgc agccaaaatg acagcttctg atggaatatc tttaacagtc
4861 tccaataatt catcaaccaa tgcttctatt acaattggtt tggatgcgga aaaagcttac
4921 cagcttattc tagaaaagtt gggaaatcaa attcttgatg gaattgctga tactattgtt
```

FIG. 24A (cont.)

```
4981  gatagtacag  tccaagatat  tttagacaaa  atcacaacag  acccttctct  aggtttgttg
5041  aaagctttta  acaacttcc   aatcactaat  aaaattcaat  gcaacgggtt  attcactccc
5101  agtaacattg  aaactttatt  aggaggaact  gaaataggaa  aattcacagt  cacacccaaa
5161  agctctggga  gcatgttctt  agtctcagca  gatattattg  catcaagaat  ggaaggcggc
5221  gttgttctag  ctttggtacg  agaaggtgat  tctaagccct  gcgcgattag  ttatggatac
5281  tcatcaggcg  ttcctaattt  atgtagtcta  agaaccagca  ttactaatac  aggattgact
5341  ccaacaacgt  attcattacg  tgtaggcggt  ttagaaagcg  gtgtggtatg  ggttaatgcc
5401  ctttctaatg  gcaatgatat  tttaggaata  acaaatactt  ctaatgtatc  tttttgaa
5461  gtaatacctc  aaacaaacgc  ttaaacaatt  tttattggat  ttttcttata  ggttttatat
5521  ttagagaaaa  cagttcgaat  tacggggttt  gttatgcaaa  ataaaagaaa  agtgagggac
5581  gattttatta  aaattgttaa  agatgtgaaa  aaagatttcc  ccgaattaga  cctaaaaata
5641  cgagtaaaca  aggaaaaagt  aactttctta  aattctccct  tagaactcta  ccataaaagt
5701  gtctcactaa  ttctaggact  gcttcaacaa  atagaaaact  ctttaggatt  attcccagac
5761  tctcctgttc  ttgaaaaatt  agaggataac  agttgttttc  taaaaaaggc  tttgattatg
5821  cttatcttgt  ctagaaaaga  catgtttttcc  aaggctgaat  agacaactta  ctctaacgtt
5881  ggagttgatt  tgcacacctt  agttttttgc  tcttttaagg  gaggaactgg  aaaaacaaca
5941  ctttctctaa  acgtgggatg  caacttggcc  caattttttag  ggaaaaaagt  gttacttgct
6001  gacctagacc  cgcaatccaa  tttatctctct  ctagtgtcag  aaataaccaa
6061  aaagcttgc   acgacatagt  atacaaatca  aacgatttaa  aatcaatcat  ttgcgaaaca
6121  aaaaagata   gtgtggacct  aattcctgca  tcattttat   ccgaacagtt  tagagaattg
6181  gatattcata  gaggacctag  taacaactta  aagttatttc  tgaatgagta  ctgcgtcct
6241  tttatgaca   tctgcataat  agacactcca  cctagcctag  gagggttaac  gaaagaagct
6301  tttgttgcag  gagacaaatt  aattgcttgt  ttaactccag  aaccttttc   tattctaggg
6361  ttacaaaga   tacgtgaatt  cttaagttcg  gtcggaaaac  ctgaagaaga  acacattctt
6421  ggaatagctt  tgtcttttg   ggatgatcgt  aactcgacta  accaaatgta  tatagacatt
6481  atcgagtcta  tttacaaaaa  caagcttttt  tcaacaaaaa  ttcgtcgaga  tatttctctc
6541  agccgttctc  ttcttaaaga  agattctgta  gctaatgtct  atccaaattc  tagggccgca
```

FIG. 24A (cont.)

```
6601 gaagatattc tgaagttaac gcatgaaata gcaaatattt tgcatatcga atatgaacga
6661 gattactctc agaggacaac gtgaacaaac taaaaaaaga agcggatgtc ttttttaaaa
6721 aaaatcaaac tgccgcttct ctagattta agaagacact tccttccatt gaactattct
6781 cagcaacttt gaattctgag gaaagtcaga gtttggatcg attatttta tcagagtccc
6841 aaaactattc ggatgaagaa tttatcaag aagacatcct agcggtaaaa ctgcttactg
6901 gtcagataaa atccatacag aagcaacacg tacttctttt aggagaaaaa atctataatg
6961 ctagaaaaat cctgagtaag gatcacttct cctcaacaac tttttcatct tggatagagt
7021 tagttttag aactaagtct tctgcttaca atgctcttgc atattacgag cttttataa
7081 acctcccaa ccaaactcta caaaagagt ttcaatcgat ccctataaa tccgcatata
7141 ttttggccgc tagaaaaggc gatttaaaa ccaaggtcga tgtgataggg aaagtatgtg
7201 gaatgtcgaa ctcatcggcg ataaggtgt tggatcaatt tcttccttca tctagaaaca
7261 aagacgttag agaaacgata gataagtctg atttagagaa gaatcgccaa ttatctgatt
7321 tcttaataga gatacttcgc atcatatgtt ccggagtttc tttgtcctcc tataacgaaa
7381 atcttctaca acagcttttt gaactttta agcaaaagag ctgatcctcc gtcagctcat
7441 atatatt attatatata tattattta gggatttgat tttacgagag aga
```

FIG. 24B

Corresponding Amino Acid Sequence of Pgp1 (SEQ ID NO: 180):

MKTRSEIENRMQDIEYALLGKALIFEDSTEYILRQLANYEFKCSHHKNIFIVFKYLKDNGLPITVDSAWEELLRRRIKD
MDKSYLGIMLHDALSNDKLRSVSHTVFLDDLSVCSAEENLSNFIFRSFNEYNENPLRRSPFLLLERIKGRLDSAIAKTF
SIRSARGRSIYDIFSQSEIGVLARIKKRRAAFSENQNSFFDGFPTGYKDIDDKGVILAKGNFVIAARPSIGKTALAID
MAINLAVTQQRRVGFLSLEMSAGQIVERIVANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 24C

Corresponding Amino Acid Sequence of Pgp2 (SEQ ID NO: 181):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRKKRIEFL
DSSKLSKKEILYLNKERFEEITKKSKEQMEQESIN

FIG. 24D

Corresponding Amino Acid Sequence of Pgp3 (SEQ ID NO: 182):

MGNSGFYLYNTENCVFADNIKVGQMTEPLKDQQILGTKSTPVAAKMTASDGISLTVSNNSSTNASITIGLDAEKAYQL
ILEKLGNQILDGIADTIVDSTVQDILDKITTDPSLGLLKAFNFPITNKIQCNGLFTPSNIETLLGGTEIGKFTVTPKS
SGSMFIVSADIIASRMEGGVVLAIVREGDSKPCAISYGYSSGVPNLCSLRTSITNTGLTPTTYSLRVGGLESGVWVNA
ISNGNDILGITNTSNVSFLEVIPQTNA

FIG. 24E

Corresponding Amino Acid Sequence of Pgp4 (SEQ ID NO: 183):

MQNKRKVRDEIKIVKDVKKDFPELDKIRVNKEKVTFLNSPLELYHKSVSLILGLLQQIENSLGLFPDSPVLEKLEDN
SLKLKKALIMLILSRKDMFSKAE

FIG. 24F

Corresponding Amino Acid Sequence of Pgp5 (SEQ ID NO: 184):

MHTLVFCSFKGGTGKTTLSLNVGCNLAQFLGKKVLLADLDPQSNLSSGLGASVRNNQKGLHDIVYKSNDLKSIICETKK
DSVDLIPASFLSEQFRELDIHRGPSNNLKFLNEYCAPFYDICIIDTPPSLGGLTKEAFVAGDKLIACLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 24G

Corresponding Amino Acid Sequence of Pgp6 (SEQ ID NO: 185):

MNKLKKEADVFKKNQTAASLDFKKTLPSIELFSATLNSEESQSLDRLFLSESQNYSDEEFYQEDILAVKLLTGQIKSI
QKQHVLLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDLEKNRQLSDFLIEILRIICSGVSLSSYNENLLQ
QLFELFKQKS

FIG. 24H

Corresponding Amino Acid Sequence of Pgp7 (SEQ ID NO: 186):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEMTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 24I

Corresponding Amino Acid Sequence of Pgp8 (SEQ ID NO: 187):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 25A

Nucleic Acid Sequence of Plasmid HE603209 (SEQ ID NO: 188):

```
   1 tttgcaactc ttggtggtag actttgcaac tcttggtggt agactttgca actcttggtg
  61 gtagactttg caactcttgg tggtagactt ggtcataatg gacttttgtt aaaaatttc
 121 ttaaatctt agagctccga tttgaatag ctttggttaa gaaaatgggc tcgatggctt
 181 tccataaaag tagattgttc ttaactttg gggacgcgtc ggaaatttgg ttatctactt
 241 tatctcatct aactagaaaa aattatgcgt ctgggattaa ctttcttgtt tctttagaga
 301 ttctggattt atcggaaaac ttgataaagg ctattctct tgaccacagc gaatctttgt
 361 ttaaaatcaa gtctctagat gttttaatg gaaaagtcgt ttcagagcc tctaaacagg
 421 ctagagcggc atgctacata tctttcacaa agtttttgta tagattgacc aaggatata
 481 ttaaacccgc tattccattg aaagattttg gaaacactac atttttaaa atccgagaca
 541 aaatcaaaac agaatcgatt tctaagcagg aatgacagt ttttttgaa gcgctccgga
 601 tagtgaatta tagagactat ttaatcggta aattgattgt acaagggatc cgtaagttag
 661 acgaaatttt gtctttgcgc acagacgatc tatttttgc atccaatcag atttccttc
 721 gcattaaaaa aagacagaat aaagaaacca aaattctaat cacatttcct atcagcttaa
 781 tggaagagtt gcaaaaatac actgtgggga gaaatgggag agtatttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgctttgatt cattaaagc
 961 aaataggatt aaaagatgag gaaatcatgc gtattccctg tctctcatcg agacaaagtg
1021 tgtgtcctta ttgttctggg gaagaggtaa gtcctctagt acaaacaccc acaatattgt
1081 gatataatta aattatatt catattctgt tgccagaaaa aacacctta ggctatatta
1141 gagccatctt cttgaagcg ttgtcttctc gagaggattt atcgtacgca aatatcatct
1201 ttgcggttgc gtgtcccgtg accttcatta tgtcggagtc tgagcaccct aggcgtttgt
1261 actccgtcac agcggttgct cgaagcacgt gcggggccga tttgcccttaa attgcagctt
1321 gtagtcctgc ttgagagaaac gtgcgggcga cttcgttgac cgatgtactc ttgtagaaag
1381 gagttacgaa gacaaaacct cttatcttt ctgtctgacg gttcttaagc atgagggagc
1441 tctgaggata agttataata atcctctttt taatctccaa gcttaagact tcagaggagc
1501 aaatggtagc ttgttgaaa caaatctgac tcaaccaatc ccgggcgttg attttttta
1561 gtttacctcc ttggagcatt gtctgggcga
```

FIG. 25A (cont.)

```
1621 gctctttag gaaggatgct gttgcaaac tgttcatcgc atccgttttt actatttccc
1681 tggttttaaa aaatgttcga ctatttctt gttagaagg ttagcgctata gcgactattc
1741 cttgagtcat cctgtttagg aatcttgtta aggaaatata gcttgctgct cgaacttgtt
1801 tagtaccttc ggtccaagaa gtcttggcag aggaaacttt tttaatcgca tctaggatta
1861 gattatgatt taaaagggaa aactcttgca gattcatatc caaagacaat agaccaatct
1921 tttctaaaga caaaaaagat cctcgatatg atctacaagt atgttttgttg agtgatgcgg
1981 tccaatgcat aataacttcg aataaggaga agctttttcat gcgtttccaa taggattctt
2041 ggcgaattt taaaacttcc tgataagact ttctcgctata ttctaacgac atttcttgct
2101 gcaaagataa aatccctta cccatgaaat gttgttaac ataacctatc cgcaaaatgt
2161 cctgattagt gaaataatca ggttgttaac aggatagcac gctcggtatt tttttatata
2221 aacatgaaaa ctcgttccga aatagaaaat gctcgagta atatcgagta tgcgttgtta
2281 ggtaaagctc tgatatttga agactctact cgcatgtattc gagtatattc tgctaattat
2341 gagtttaagt gttccatca taaaacata ttcatagtat ttaaatactt aaaagacaat
2401 ggattaccta taactctaga ctcggcttgg gaagagctct tgcggcgtcg tatcaaagat
2461 atgacaaat cgtatctcgg gttaatgttg catgatgcat ttgagcgtga caagcttaga
2521 tcgttctc atacgttttt cctcgatgat cctcgatgat gtagcgctga agaaaatttg
2581 agcaatttca ttcgctc gttttaatgag tacaatgaaa atccattgcg tagatctccg
2641 tttctattgc ttgagcgtat aaagggaagg cttgatagtg ctatagcaaa gactttttct
2701 attcgcagcg ctagaggccg gtctatttat gatatattct cacagtcaga aattggagtg
2761 ctggctcgta taaaaaaaag acgagcagcg ttctctgaga atcaaaattc tttctttgat
2821 ggcttcccaa caggatacaa ggatattgat gataaaggag ttatcttagc taaggtaat
2881 ttcgtgatta tagcagctag gccatctata gggaaaacag ctttagctat agacatggcg
2941 ataaatcttg cggttactca acagcgtaga gttggtttcc tatctctaga aatgagcgca
3001 ggtcaaattg ttgagcggat tattgctaat ttaacaggaa tatctggtga aaaattacaa
3061 agaggggatc tctctaaaga agaattattc cgagtagaag aagctggaga aacagttaga
3121 gaatcacatt tttatatctg cagtgatagt cagtatatagc ttaatttaat cgcgaatcag
3181 atccagttgc tgagaaaaga agatcgagta gacgtaatat ttatcgatta cttgcagttg
3241 atcaactcat cggttggaga aaatcgtcaa aatgaaatag cagatatatc tagaaccttta
```

FIG. 25A (cont.)

```
3301 agaggtttag cctcagagct aaacattcct atagtttgtt tatcccaact atctagaaaa
3361 gttgaggata gagcaaataa agttcccatg ctttcagatt tgcgagacag cggtcaaata
3421 gagcaagacg cagatgtgat tttgtttatc aataggaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccaccct gaaaatcaga agtttggaag aagacctggt caatctatta
3661 agatatctcc caaattggct caaaatggga tggtagaagt tataggtctt gatttttctt
3721 catctcatta ccatgcatta gcagctatcc aaagattact gaccgcaacg aattacaagg
3781 ggaacacaaa aggggttatt ttatccagag aatcaaatag ttttcaattt gaaggatgga
3841 taccagaat ccgttttaca aaaactgaat tcttagaggc ttatggagtt aagcggtata
3901 aaacatccag aaataagtat gagtttagtg gaaaagaagc tgaaactgct ttagaagcct
3961 tataccattt aggacatcaa ccgtttttaa tagtgcaac tgaaactcga tggactaatg
4021 gaacacaaat agtagaccgt taccaaactc ttttctccgat cattaggatt tacgaaggat
4081 gggaaggttt aactgacgaa gaaaatatag atatagactt aacaccttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgtttcccaa
4261 atgcatcaaa gtatgcttac acatttatcg actgggtgat tacagcagct gcgaaaaaga
4321 gacgaaaatt aactaaggat aattctttggc cagaaaactt gttattaaac gttaacgtta
4381 aaagtcttgc atatatttta aggatgaatc ggtacatctg tacaaggaac tggaaaaaaa
4441 tcgagttagc tatcgataaa tgtatagaaa tcgccattca gcttggctgg ttatctagaa
4501 gaaaacgtat tgaattctg gattccttcta aactctctaa aaaagaaatt ctatatctaa
4561 ataaagagcg ctttgaagaa ataactaaga aatctaaaga acaaatggaa caattagaac
4621 aagaatctat taattaatag caagcttgaa actaaaaacc taatttattt aaagctcaaa
4681 ataaaaaga gtttaaaat gggaaattct ggttttttatt tgtataacac tgaaaactgc
4741 gtctttgctg ataatatcaa agttgggcaa atgacagagc cgctcaagga ccagcaaata
4801 atcctttggga caacataac acctgtcgca gccaaaatga cgcttctga cagcttctga tggaatatct
4861 ttaacagtct ccaataattc atcaaccaat gcttctatta caattggttt ggatgcggaa
4921 aaagcttacc agcttattct agaaaagttg ggagatcaaa ttcttgatgg aattgctgat
```

FIG. 25A (cont.)

```
4981  actattgttg  ataatacagt  ccaagatatt  ttagacaaaa  tcaaacaga   cccttctcta
5041  ggtttgttga  aagcttttaa  caactttcca  atcactaata  aaattcaatg  caacgggtta
5101  ttcactccca  gtagcattga  aacttattta  ggaggaactg  aaataggaaa  attcacagtc
5161  acacccaaaa  gctctgggag  catgttctta  gtctcagcag  atattattgc  atcaagaatg
5221  gaaggcggcg  ttgttctagc  tttggtacga  gaaggtgatt  ctaagccctg  cgcgattagt
5281  tatggatact  catcaggcgt  tcctaattta  tgtagtctaa  gaaccagcat  tactaataca
5341  ggattgactc  caacaacgta  ttcattacgt  gtaggcggtt  tagaaagcgg  tgtggtatgg
5401  gttaatgccc  tttctaatgg  caatgatatt  ttaggaataa  caaatacttc  taatgtatct
5461  ttttggaag   taatacctca  aacaaacgct  taaacaattt  ttattggatt  tttcttatag
5521  gttttatatt  tagagaaaac  agttcgaatt  acggggtttg  ttatgcaaaa  taaaagaaaa
5581  gtgaggacg   atttattaa   aattgttaaa  gatgtgaaaa  aagatttccc  cgaattagac
5641  ctaaaaatac  gagtaaacaa  ggaaaaagta  acttttcttaa actctccctt  agaactctac
5701  cataaaagtg  tctcactaat  tctaggactg  cttcaacaaa  tagaaaactc  tttaggatta
5761  ttcccagact  ctcctgttct  tgaaaaatta  gaggataaca  gtttaaagct  aaaaaaggct
5821  ttgattatgc  ttatcttgtc  tagaaaagac  atgttttcca  aggctgaata  gacaacttac
5881  tctaacgttg  gagttgattt  gcacaccta   gttttttttgct ctttaaggg  aggaactgga
5941  aaaacaacac  tttctctaa   cgtgggatgc  aacttggccc  aattttagg   gaaaaaagtg
6001  ttacttgctg  acctagaccc  gcaatccaat  ttatcttctg  gattggggc   tagtgtcaga
6061  agtaaccaaa  aaggcttgca  cgacatagta  tacacatcaa  acgatttaaa  atcaatcatt
6121  tgcgaaacaa  aaaaagatag  tgtggaccta  attcctgcat  cattttatc   cgaacagttt
6181  agagaattgg  atattcatag  aggacctagt  aacaacttaa  agttatttct  gaatgagtac
6241  tgcgctcctt  tttatgacat  ctgcataata  gacactccac  ctagcctagg  agggttaacg
6301  aaagaagctt  ttgttgcagg  agacaaatta  attgttttgtt taactccaga  accttttct
6361  attctagggt  tacaaaagat  acgtgaattc  ttaagttcgg  tcggaaaacc  tgaagaagaa
6421  cacattcttg  gaatagcttt  gtcttttttgg gatgatcgta  actcgactaa  ccaaatgtat
6481  atagacatta  tcgagtctat  ttacaaaaac  aagctttttt  caacaaaaat  tcgtcgagat
6541  attctctca   gccgttctct  tcttaaagaa  gattctgtag  ctaatgtcta  tccaaattct
```

FIG. 25A (cont.)

```
6601 agggccgcag aagatattct gaagttaacg catgaaatag caaatatttt gcatatcgaa
6661 tatgaacgag attactctca gaggacaacg tgaacaaact aaaaaaagaa gcggatgtct
6721 ttttaaaaa aaatcaaact gccgcttctc tagattttaa gaagacactt cctccattg
6781 aactattctc agcaactttg aattctgagg aaagtcagag tttggatcga ttattttat
6841 cagagtccca aaactattcg gatgaagaat tttatcaaga agacatccta gcggtaaaac
6901 tgcttactgg tcagataaaa tccatacaga agcaacacgt acttctttta ggagaaaaaa
6961 tctataatgc tagaaaaatc ctgagtaagg atcactctc ctcaacaact ttttcatctt
7021 ggatagagtt agtttttaga actaagtctt ctgcttgca tgctcttgca tattacgagc
7081 ttttataaa cctcccaac caaactctac aaaaagagtt tcaatcgatc ccctataaat
7141 ccgcatatat tttggccgct agaaaaggcg atttaaaaac caaggtcgat gtgataggga
7201 aagtatgtgg aatgtcgaac tcatcggcga taaggtgtt ggatcaattt cttccttcat
7261 ctagaaacaa agacgttaga gaaacgatag atacttcgca ttcagagaag aatcgccaat
7321 tatctgattt cttatagag tcatatgttc tcatatgttc cggagtttct ttgtcctcct
7381 ataacgaaaa tcttctacaa cagcttttg aacttttttaa gcaaaagagc tgatcctccg
7441 tcagctcata tatatttta ttatatat atttattag ggatttgatt ttacgagaga
7501 ga
```

FIG. 25B

Corresponding Amino Acid Sequence of Pgp1 (SEQ ID NO: 189):

MKTRSEIENRMQDIEYALLGKALIFEDSTEYILRQLANYEFKCSHHKNIFIVFKYLKDNGLPITVDSAWEELLRRRIKD
MDKSYLGIMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIQLLRKEDRVDVIFIDYLQLINSSVGENRQNEIADISRTLRGLASELNIPIVCLSQLSRKVEDRANKVPMLSDLRD
SGQIEQDADVILFINRKESSNCEITVGKNRHGSVFSSVLHFDPKISKFSAIKKVW

FIG. 25C

Corresponding Amino Acid Sequence of Pgp2 (SEQ ID NO: 190):

MVNYSNCHFIKSPIHLENQKFGRRPGQSIKISPKLAQNGMVEVIGLDFLSSHYHALAAIQRLLTATNYKGNTKGVILSR
ESNSFQFEGWIPIRIFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 25D

Corresponding Amino Acid Sequence of Pgp3 (SEQ ID NO: 191):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 25E

Corresponding Amino Acid Sequence of Pgp4 (SEQ ID NO: 192):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 25F

Corresponding Amino Acid Sequence of Pgp5 (SEQ ID NO: 193):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNIKLFLNEYCAPFYDICIIDTPPSLGGLTKEAFVAGDKLIVCLTPEPFSILGL
QKIREFLSSVGKPEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 25G

Corresponding Amino Acid Sequence of Pgp6 (SEQ ID NO: 194):

MNKLKKEADVFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIICSGVSLSSYNENLLQ
QLFELFKQKS

FIG. 25H

Corresponding Amino Acid Sequence of Pgp7 (SEQ ID NO: 195):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 25I

Corresponding Amino Acid Sequence of Pgp8 (SEQ ID NO: 196):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSEISQICFQQATISFSQLKNRQTEKRIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 26A

Nucleic Acid Sequence of Plasmid CP000052 (SEQ ID NO: 197):

```
   1 aatatgaata taattttaat tatatcacaa tattgtgggt gtttgtacta gaggacttac
  61 ctcttcccca gaacaataag aacacacact ttgtctcgat gagagacagg aaatacgcat
 121 gattcctca tcttttaatc ctattgctt taaatgaatc aaagcgcttg cacgaagtac
 181 tctgggagta attttttattt tcatagcact atggaactct gcaagcctaa aattatgcgc
 241 aacctgactt gttgttacag gaatccctat tttagaaaca aatactctcc cattctccc
 301 acaagtgtat tttgcaact cttccattaa gctgatagga aatgtgatta gaattttggt
 361 ttcttatttc tgtctttttt taatgcgaaa ggaaatctga ttggatgcaa aaaatagatc
 421 gtctgtgcgc aaagacaaaa tttcgtctaa ctacggatc ccttgtacaa tcaatttacc
 481 gattaaatag tctctataat tcactatccg gagcgcttca aaaaaaactg tccattcctg
 541 cttagaaatc gattctgttt tgatttgtc tcggatttta aaaaatgtag tgtttccaaa
 601 atctttcaat ggaatagcgg gtttaatata tcccttggtc aatctataca aaaactttgt
 661 gaaagatatg tagcatgccg ctctagcctg tttagaggcc tctgaaacga cttttccatt
 721 aaaacatct agagacttga ttttaaacaa agattcgctg tggtcaagag aaatagcctt
 781 tatcaaggtt tccgataaat ccagaatctc taaagaaaca agaaagttaa tcccagacgc
 841 ataattttt ctagttagat gagataaagt agataaaagt atttcgacg cgtcccaaa
 901 agttaagaac aatctactt tatgaaaagc catcgagcc attttcttaa ccaagctat
 961 tcaaatcgg agctctctaa ttttaagaa tttttaaca aagtccatt atgaccaagt
1021 ctaccaccct accaccaaga gttgcaaagt ctaccactctc gagttgcaaa gtctaccacc
1081 aagagttgca aagtctacca ccagagttg caaatatg ggatcagctc aaatccctaa
1141 ataatatat aagtatata tatatatatg agaagatttt cgttatagga actccggaac
1201 aagttcaaa aagctgttgt agaagatttt cgttatagga ggaacaaaga actccggaac
1261 atatgatcg aagtatctct attaagaaat cagataattg gcgattcttc tctgaatcag
1321 acttatctat cgttctctta acgtctttgt ttctagatga aggaagaaat tgatccaaca
1381 cccttatcgc cgatgagttc gacattcccac atactttccc tatcacatcg accttggttt
1441 ttaatcgcc tttctagcg gccaaaatat atgcggattt ataggggatc gattgaaact
1501 cttttgtag agtttggttg gggaggttta taaaaagctc gtaatatgca agagcattgt
1561 aagcagaaga cttagttcta aaactaact ctatccaaga tgaaaagtt gttgaggaga
```

FIG. 26A (cont.)

```
1621  agtgatcctt actcaggatt tttctagcat tatagatttt ttctcctaaa agaagtacgt
1681  gttgctctg tatggatttt atctgaccag taagcagttt atctgctag atgtcttctt
1741  gataaaattc ttcatccgaa tagttttggg actctgataa aaataatcga tccaaactct
1801  gactttcctc agaattcaaa gttgctgaga atagttcaat ggaaggaagt gtcttcttaa
1861  aatctagaga agcggcagtt tgatttttt taaaaaagac atccgcttct ttttttagtt
1921  tgttcacgtt gtcctctgag agtaatctcg ttcatatcg atatgcaaaa tatttgctat
1981  ttcatgcgtt aacttcagaa tatcttctgc ggccctagaa tttggataga cattagctac
2041  agaatcttct ttaagaagag aacggctgag agaaatatct cgacgaattt ttgttgaaaa
2101  aagcttgttt ttgtaaatag actcgataat atttggttag tcgagttacg
2161  atcatcccaa aaagacaaag ctattccaag gtctatatac tctttcaggtt ttccgaccga
2221  acttagaat tcacgtatct tttgtaaccc aatgtgttct aaaggttctg gagttaaaca
2281  aacaattaat ttgtctcctg caacaaaagc tagaatagaa aaccctccta ggctaggtgg
2341  agtgtctatt atgcagatgt cataaaaagg agcgcagtac tcattcagaa ataactttaa
2401  gttgttacta ggtcctctat gaatatccaa ttctctaaac tgttcggata aaaatgatgc
2461  aggaattagg gtgtgcaaag ctttttttgt ttcgcaaatg attgatttta aatcgtttga
2521  tgtgtatact atgtcgtgca agccttttg gttactcctg acactagccc ccaatccaga
2581  agataaattg gattgcgggt ctaggtcagc aagtaacact ttttccccta aaaattgggc
2641  caagttgcat cccacgttta gagaagtgt tgttttttcca gttcctccct taaaagagca
2701  aaaaactaag gtgtgcaaac caactccaac gttagagtaa gttgtctatt cagccttgga
2761  aaacatgtct tttctagaca agataagcat aatcaaagcc tttttagct ttaaactgtt
2821  atcctctaat ttttcaagaa caggagagtc tgggaataat cctaaagagt tttctatttg
2881  ttgaagcagt cctagaatta gtgagacact tttatggtag agttctaagg gagaatttaa
2941  gaaagttact ttttccttgt gtactcgtat ttttaggtct aattcgggga aatcttttt
3001  cacatcttta acaattttaa taaaatcgtc cctcacttt cttttattt gcataacaaa
3061  cccgtaatt cgaactgttt tctctaaata tctctaaata aagaaaaatc caataaaaat
3121  tgtttaagcg tttgttgag gtattactc caaaaaagat acattagaag tatttgttat
3181  tcctaaaata tcattgccat tagaaagggc attaacccat accacacccgc tttctaaacc
```

FIG. 26A (cont.)

```
3241 gcctacacgt aatgaatacg ttgttggagt caatcctgta ttagtaatgc tggttcttag
3301 actacataaa ttaggaacgc ctgatgagta tccataacta atcgcgcagg gcttagaatc
3361 accttctcgt accaagcta gaacaacgcc gccttccatt cttgatgcaa taatatctgc
3421 tgagactaag aacatgctcc cagagcttt gggtgtgact gtgaattttc ctatttcagt
3481 tcctcctaat aaagtttcaa tgctactggg agtgaataac ccgttgcatt gaatttatt
3541 agtgattgga aagttgttaa agctttcaa caaacctaga gaagggtctg ttttgatttt
3601 gtctaaaata tctttggactg tattatcaac aatagtatca gcaattccat caagaatttg
3661 atctcccaac ttttctagaa taagctggta agcttttcc gcatccaaac caattgtaat
3721 agaagcattg gttgatgaat tattggagac tgtttaaagat attccatcag aagctgtcat
3781 tttggctgcg acaggtgttg atgttgtccc aagattat tgctggtcct tgagcggctc
3841 tgtcatttgc ccaactttga tattatcagc tttttcagtgt tatacaaata
3901 aaaaccagaa ttcccattt taaaactctt tttatttttg agctttaaat aaattaggtt
3961 tttagttca agcttgctat taattaatag attcttgttc taattgttcc attgtcttt
4021 tagatttctt agttattct tcaaagcgct ctttatttag atatagaatt tctttttag
4081 agagtttaga agaatccaga aattcaatac gttttctct agataaccag ccaagctgaa
4141 tggcgatttc tatacattta tcgatagcta actcgattt tttccagttc cttgtacaga
4201 tgtaccgatt catccttaaa atatatgcaa gactttaac gttaacgttt aataacaagt
4261 ttctggcca agaattatcc ttagttaatt ttcgtctctt ttcgcagct gctgtaatca
4321 cccagtcgat aaatgtgtaa gcatacttg atgcatttgg gaaacgcatt tttatttctt
4381 ggtatacatt tgcagcttg attacaaagt aggattctat ttgatctacc aagataggac
4441 atggctctac aacgaaccct ttatgtttcc gtgtagatgg cttcccatcc aagtgttaagt
4501 ctatatctat attttcttcg tcagttaaac cttgtaaatc ttcgtaaatc ctaatgatcg
4561 gagaaagagt ttggtaacgg tctactattt gtgttccatt agtccatcga gttctagttg
4621 ccactattaa aaacggttga tgtcctaaat ggtataaggc ttctaaagca gtttcagctt
4681 ctttccact aaactcatac ttattctgg atgttttata ccgcttaact ccataagcct
4741 ctaagaattc agttttgta ttgtatcca tcctttcaaat tgaaactat
4801 ttgattctct ggataaaata accccttttg tgttccctt gtaattcgtt gcggtcagta
4861 atctttggat agctgctaat gcatggtaat gagatgaaag aaaatcaaga cctataactt
```

FIG. 26A (cont.)

```
4921 ctaccatccc atttttgagcc aatttgggag atatcttaat agattgacca ggtctttcttc
4981 caaacttctg attttcaagg tggataggac tttgatgaa gtggcagtta ctatatatta
5041 ccatacttt ttaatagcgg agaatttact aattttttgga tcgaaatgta ataccgaaga
5101 gaaaccgat ccatgtctat ttttcccaac agttatctca caattagaag acgattcctt
5161 cctattgata aacaaaatca catctgcgtc ttgctctatt tgaccgctgt ctcgcaaatc
5221 tgaaagcatg ggaactttat ttgctctatc ctcaacttt ctagatagtt gggataaaca
5281 aactatagga atgtttagct ctgaggctaa accttcttaag gttctagata tatctgctat
5341 ttcattttga cgatttctc caaccgatga gttgatcaac tgcaagtaat cgataaatat
5401 tacgtctact cgatcttctt ttctcagcaa ctggatctga ttcgcgatta aattaagctt
5461 atactgacta tcactgcaga tataaaaatg tgattctcta actgttttctc cagcttcttc
5521 tactcggaat aattcttctt tagagagatc ccctctttgt aattttttcac cagatattcc
5581 tgttaaatta gcaataatcc gctcaacaat ttgacctgcg ctcatttcta gagataggaa
5641 accaactcta cgctgttgag taaccgcaag atttatcgcc atgtctatag ctaaagctgt
5701 tttccctata gatggcctag ctgctataat cacgaaatta cctttagcta agataactcc
5761 tttatcatca atatccttgt atcctgttgg gaagccatca gaaaagaat tttgattctc
5821 agagaacgct gctcgtcttt ttttatacg agccagcact ccaatttctg actgtgagaa
5881 tatatcataa atagaccggc ctctagcgct gcgaatagaa aaagtctttg ctatagcact
5941 atcaagcctt cccttatac gctcaagcaa tagaaacgga gatctacgca atggatttc
6001 attgtactca ttaaacgagc ggaaaatgaa attgctcaaa ttttcttcag cgctacacac
6061 gctcaaatca tcgaggaaaa ccgtatgaga aacggatcta agcttgtcat ttgataaagc
6121 atcatgcaac attaaaccga gatacgattt gtccatatct ttgatacgac gccgcaaag
6181 ctcttcccaa gccgagtcta cagttatagg taatccattg tctttttaagt atttaaatac
6241 tatgaatatg tttttatgat gggaacactt aaaactcataa ttagcaagct gcctcagaat
6301 atactcagta gagtcttcaa atatcagagc tttacctaac aacgcatact cgatatcttg
6361 catgcgattt tctatttcgg aacgagtttt catgttttata taaaaaaata ccgagcgtgc
6421 tatcctgtta acaacctgat tatttcacta atcaggacat tttgcggata ggttatatca
6481 cgagggattt catgggtaaa gggattttat ctttgcagca agaaatgtcg ttagaatata
```

FIG. 26A (cont.)

```
6541 gcgaaaagtc ttatcaggaa gttttaaaaa ttcgccaaga atcctattgg aaacgcatga
6601 aaagcttctc cttattcgaa gttattatgc attggaccgc atcactcaac aaacatactt
6661 gtagatcata tcgagatct ttttgtctt tagaaaagat tggtctattg tctttggata
6721 tgaatctgca agagttttcc cttttaaatc ataatctaat cctagatgcg attaaaaaag
6781 tttcctctgc caagacttct tggaccgaag gtactaaaca agttcgagca gcaagctata
6841 tttccttaac aagattccta aacaggatga ctcaaggaat agtcgctata gcgcaacctt
6901 ctaaacaaga aaatagtcga acattttta aaaccaggga aatagtaaaa acggatgcga
6961 tgaacagttt gcaaacagca tccttcctaa aagagctaaa aaaaatcaac gcccgggatt
7021 ggttgatcgc ccagacaatg tctccaagga gtaaacgctc ctctgaagtc ttaagcttgg
7081 agattagtca gatttgtttc caacaagcta ccattctctt ctcccagctt aagaaccgtc
7141 agacagaaaa gaggattatt ataacttatc tatgcacttt tatgcacttt tatcaagagt
7201 acatcggtca acgaagaggt tttgtcttcg taactcgctc cggaaaaatg gtggggttaa
7261 ggcaaatcgc ccgcacgt gcttcgagca gactacaagc tgcaatccct tttaagataa
7321 ccccgcacgt gaaggtcacg cggagtacaa acgcctaggg tgctcagact
7381 ccgacataat gaaggtcacg ggacacgcaa ccgcaaagat gatatttgcg tacgataaat
7441 cctctcgaga agacaatgct tcaaagaaga tggctctaaa atagcctaaa ggtgtttttt
7501 ctggcaacag
```

FIG. 26B

Corresponding Amino Acid Sequence of Pgp1 (SEQ ID NO: 198):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIQLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 26C

Corresponding Amino Acid Sequence of Pgp2 (SEQ ID NO: 199):

MVNYSNCHFIKSPIHLENQKFGRRPGQSIKISPKLAQNGMVEVIGLDFLSSHYHALAAIQRLLTATNYKGNTKGVILSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 26D

Corresponding Amino Acid Sequence of Pgp3 (SEQ ID NO: 200):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVWVNA
LSNGNDILGITNTSNVSFLEVIPQTNA

FIG. 26E

Corresponding Amino Acid Sequence of Pgp4 (SEQ ID NO: 201):

MQNKRKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 26F

Corresponding Amino Acid Sequence of Pgp5 (SEQ ID NO: 202):

MGCNLAQFLGKKVLLADLDPQSNLSSGLGASVRSNQKGLHDIVYTSNDLKSIICETKKDSVDLIPASFLSEQFRELDIH
RGPSNNLKLFLNEYCAPFYDICIIDTPPSLGGLTKEAFVAGDKLIVCLTPEPFSILGLQKIREFLSSVGKPEEEHILGI
ALSFWDDRNSTNQMYIDIIESIYKNKLFSTKIRRDISLSRSLLKEDSVANVYPNSRAAEDILKLTHEIANILHEYERD
YSQRTT

FIG. 26G

Corresponding Amino Acid Sequence of Pgp6 (SEQ ID NO: 203):

MNKLKKEADVFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDEKNRQLSDFLIEILRIICSGVSLSSYNENLLQ
QLFELFKQKS

FIG. 26H

Corresponding Amino Acid Sequence of Pgp7 (SEQ ID NO: 204):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFASNQISFRIKRQNKETKILITFPISLMEELQKYTCGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 26I

Corresponding Amino Acid Sequence of Pgp8 (SEQ ID NO: 205):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSEISQICFQQATISFSQLKNRQTEKRIIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 27A

Nucleic Acid Sequence of Plasmid CP002402 (SEQ ID NO: 206):

```
   1 aatatgaata taattttaat tatatcacaa tattgtgggt gtttgtacta gaggacttac
  61 ctcttcccca gaacaataag aacacacact ttgtctcgat gagagacagg aaatacgcat
 121 gatttcctca tcttttaatc ctatttgctt taaatgaatc aaagcgcttg cacgaagtac
 181 tctggagta attttattt tcatagcact atgaactct gcaagcctaa aattatgcgc
 241 aacctgactt gttgttacag gaatccctat tttagaaaca aatactctcc catttctccc
 301 acaagtgtat ttttgcaact cttccattaa gctgatagga aatgtgatta gaatttggt
 361 ttcttattc tgtcttttt taatgcgaaa ggaaatctga ttggatgcaa aaaatagatc
 421 gtctgtgcgc aaagacaaaa tttcgtctaa cttacgatc ccttgtacaa tcaatttacc
 481 gattaatag tctctataat tcactatccg gagcgcttca aaaaaactg tccattcctg
 541 cttagaaatc gattctgtt tgattttgtc tcggatttta aaaaatgtag tgtttccaaa
 601 atctttcaat ggatagcgg gtttaatata tcccttggtc aatctataca aaaactttgt
 661 gaaagatatg tagcatgccg ctctagcctg tttagaggcc tctgaaacga ctttccatt
 721 aaaacatct agagacttga ttttaaacaa agattcgctg tggtcaagag aaatagcctt
 781 tatcaagtt tccgataaat ccagaatctc taaagaaaca agaaagttaa tcccagacgc
 841 ataattttt ctagttagat gagataaagt agataaccaa atttccgacg cgtccccaaa
 901 agttaagaac aatctacttt tatgaaaagc catcgagccc atttcttaa ccaagctat
 961 tcaaaatcgg agctctaaga tttaagaaa tttttaaca aaagtccatt atgaccaagt
1021 ctaccaccaa gagttgcaaa gtctaccacc aagagttgca aagtctacca ccaagagttg
1081 caaatctctc tcgtaaaatc aaatccctaa ttttgcttaa atataatat aagctgttgt agaagatttt
1141 agctgacgga ggatcagctc ttttgcttaa aaagttcaaa aagctgttgt agaagatttt
1201 cgttatagga ggacaaagaa actccggaac atatgatgcg agtatctct attaagaaat
1261 cagataattg gcgattcttc tctgaatcag acttatctat cgttctcta acgtctttgt
1321 ttctagatga aggaagaaat tgatccaaca cccttatcgc cgatgagttc gacattccac
1381 atactttccc tatcacatcg accttggttt ttaaatcgcc ttttttgtag gccaaaatat
1441 atgcggattt atagggatc gattgaaact ctttttgttg agtttggttg ggggttta
1501 taaaagctc gtaatatgca agagcattgt aagcagaaga cttagttcta aaaactaact
1561 ctatccaaga tgaaaaagtt gttgaggaga agtgatcct actccaggatt tttctagcat
```

FIG. 27A (cont.)

```
1621 tatagatttt ttctcctaaa agaagtacgt gttgcttctg tatgatttt atctgaccag
1681 taagcagttt taccgctagg atgtcttctt gataaaattc ttcatccgaa tagttttggg
1741 actctgataa aaataatcga tccaaactct gactttcctc agaattcaaa gttgctgaga
1801 atagttcaat ggaaggaagt gtcttcttaa aatctagaga agcggcagtt tgatttttt
1861 taaaaagac atccgcttct ttttttagtt tgttcacgtt gtcctctgag agtaatctcg
1921 ttcatattcg atatgcaaaa tatttgctat ttcatgcgtt aacttcgaa tatcttctgc
1981 ggccctagaa tttggataga cattagctac agaatcttct ttaagagag aacggctgag
2041 agaaatatct cgacgaattt ttgttgaaaa aagcttgtt tgtaaatag actcgataat
2101 gtctatatac atttggttag tcgagttaca atcatcccaa aagacaaag ctattccaag
2161 aatgtgttct tcttcaggtt ttccgaccga acttagaat tcacgtatct tttgtaacc
2221 tagaatagaa aaaggttctg gagttaaaca aacaattaat ttgtctcctg caacaaaagc
2281 ttctttcgtt aaccctccta ggctaggtgg agtgtctatt atgcagatgt cataaaaag
2341 agcgcagtac tcattcagaa ataactttaa gttgttacta gtcctctat gaatatccaa
2401 ttctctaaac tgttcggata aaaatgatgc aggaattagg tccacactat ctttttttgt
2461 ttcgcaaatg attgatttta aatcgtttga tgtgtatact atgtcgtgca agccttttg
2521 gttacttctg acactagccc ccaatccaga agataaattg gattgcgggt ctaggtcagc
2581 aagtaacact ttttttccta aaaattgggc caagttgcat cccacgttta gagaaagtgt
2641 tgtttttcca gtcctcccct taaaagagca aaaaactaag gtgtgcaaat caactccaac
2701 gttagagtaa gttgtctatt cagccttgga aaacatgtct tttctagaca agataagcat
2761 aatcaaagcc ttttttagct ttaaactgtt atcctctaat ttttcaagaa caggagagtc
2821 tgggaataat cctaaagagt ttctatttg ttgaagcagt cctagaatta gtgagacact
2881 tttatggtag agttctaagg gagaatttaa gaaagttact tttccttgt ttactcgtat
2941 ttttaggtct aatcggggga aatctttttt cacatcttta acaatttttaa taaaatcgtc
3001 cctcactttt ctttattt gcataacaaa cccgtaatt cgaactgttt tctctaaata
3061 taaacctaat aagaaaaaat caataaaaat tgtttaagcg tttgtttgag gtattacttc
3121 caaaaagat acattagaag tatttgttat tcctaaaata tcattgccat tagaaagggc
3181 attaacccat accacaccgc tttctaaacc gcctacacgt aatgaatacg ttgttggagt
```

FIG. 27A (cont.)

```
3241 caatcctgta ttagtaatgc tggttcttag actacataaa ttaggaacgc ctgatgagta
3301 tccataacta atcgcgcagg gcttagaatc acctttctcgt accaaagcta gaacaacgcc
3361 gccttccatt cttgatgcaa taatatctgc tgagactaag aacatgctcc cagagctttt
3421 gggtgtgact gtgaattttc ctatttcagt tcctcctaat aaagtttcaa tgctactggg
3481 agtgaataac ccgttgcatt gaatttatt agtgattgga aagttgttaa aagctttcaa
3541 caaacctaga gaagggtctg tttgatttt gtctaaaata tcttggactg tattatcaac
3601 aatagtatca gcaattccat caagaatttg atctcccaac tttctagaa taagctggta
3661 agcttttcc gcatccaaac caattgtaat agaagcattg gttgatgaat tattggagac
3721 tgttaaagat attccatcag aagctgtcat tttggctgcg acaggtgttg atgttgtccc
3781 aaggattatt tgctggtcct tgagcggctc tgtcatttgc ccaacttga tattatcagc
3841 aaagacgcag tttcagtgt tatacaaata aaaaccagaa tttcccattt taaaactctt
3901 tttattttg agcttaaat aaattaggtt tttagtttca agcttgctat agttatttct tcaaagcgct
3961 attctgttc tcttatttag atataagaatt tctttttag tagatttctt agaatccaga aattcaatac
4021 cttattttag atataagaatt tctttttag ccaagctgaa tggcgatttc tatacattta tcgatagcta
4081 gttttcttct agataaccag ccaagctgaa tggcgatttc tatacattta tcgatagcta
4141 actcgattt tttaacgttt cttgtacaga tgtaccgatt catccttaaa atatatgcaa
4201 gacttttaac gttaacgttt aataacagtt agaatttatcc ttagttaatt
4261 ttcgtctctt ttcgcagct gctgtaatca cccagtcgat aaatgtgtaa gcatcctttg
4321 atgcatttgg gaaacgcatt tttattctt ggtatacatt tgcaggcttg attacaaagt
4381 aggattctat ttgatctacc aagataggac atggctctac attttcttcg ttatgtttcc
4441 gtgtagatgg tgaattaaaa ggtgttaagt ctaatgatcg gagaaagagt tcactatttt
4501 cttcccatcc ttcgtaaaatc ctactgatcg ccactattaa aacggttga tgtcctaaat
4561 gtgttccatt agtccatcga gttctagttg gtttcagctt cttttccact aaactcatac
4621 ggtataagc ttctaaagca ttcagtgctt ctaagcct aaacttcct agtttttgta aacggattc
4681 atgttttata ccgcttaact ccataagcct ctaagaattc agttttgtga ggataaaata accccttttg
4741 ttggtatcca tccttcaaat tgaaaactat ttgattctct ggataaaata accccttttg
4801 tgttccctt gtaattcgtt gcggtcagta atctttgat agctgctaat gcatggtaat
4861 gagatgaaag aaaatcaaga cctataactt attttgagcc atttgggag
```

FIG. 27A (cont.)

```
4921 atatcttaat agattgacca ggtcttcttc caaacttctg attttcaagg tggataggac
4981 ttttgatgaa gtggcagtta ctataattta ccatactttt ttaatagcgg agaatttact
5041 aattttgga tcgaaatgta ataccgaaga gaaaaccgat ccatgtctat ttttcccaac
5101 agttatctca caattagaag acgattcctt cctattgata aacaaaatca catctgcgtc
5161 ttgctctatt tgaccgctgt ctcgcaaatc tgaaagcatg ggaactttat ttgctctatc
5221 ctcaactttt ctagatagtt gggataaaca aactatagga atgtttagct ctgaggctaa
5281 acctcttaag gttctagata tatctgctat ttcattttga cgattttctc caaccgatga
5341 gttgatcaac tgcaagtaat cgataaatat tacgtctact cgatcttctt ttctcagcaa
5401 ctggatctga ttcgcgatta aattaagctt atactgacta tcactgcaga tataaaaatg
5461 tgattctcta actgttctc cagcttcttc tactcggaat aattcttctt tagagagatc
5521 ccctctttgt aatttttcac cagatattcc tgttaaatta gcaataatcc gctcaacaat
5581 ttgacctgcg ctcattttcta gagataggaa accaactcta cgctgtttgag taaccgcaag
5641 atttatcgcc atgtctatag ctaaagctgt tttccctata gatggcctag ctgctataat
5701 cacgaaatta ccttagcta agataactcc tttatcatca atatcctttgt atcctgttgg
5761 gaagccatca aagaaagaat tttgattctc agagaacgct gctcgtcttt tttttatacg
5821 agccagcact ccaattctg actgtgagaa tatatcataa atagaccggc ctctagcgct
5881 gcgaatagaa aaagtctttg ctatagcact atcaagcctt ccctttatac gctcaagcaa
5941 tagaaacgga gatctacgca atggattttc attgtactca ttaaacgagc ggaaaatgaa
6001 attgctcaaa tttccttcag cgctacacac gctcaaatca tcgaggaaaa ccgtatgaga
6061 aacggatcta agcttgtcat ttgatacgac atcatgcaac attaaccoga gataccgatt
6121 gtccatatct tgatacgac gccgcaaaag ctcttcccaa gccgagtcta cagttatagg
6181 taatccattg tcttttaagt atttaaatac tatgaatatg ttttatgat gggaacactt
6241 aaactcataa ttagcaagct gcctcagaat atactcagta gagtcttcaa atatcagagc
6301 tttacctaac aacgcatact cgatatcttg catgcgattt tctatttcgg aacgagtttt
6361 catgtttata taaaaaaata catgcgtgc tatcctgtta acaacctgat tatttcacta
6421 atcaggacat tttgcggata cgagggattt ggttatatca cgaggattt catgggtaaa gggatttat
6481 ctttgcagca agaaatgtcg ttagaatata gcaaaaagtc ttatcaggaa tatcaggaa gttttaaaaa
```

FIG. 27A (cont.)

```
6541 ttcgccaaga atcctattgg aaacgcatga aaagcttctc cttattcgaa gttattatgc
6601 attggaccgc atcactcaac aaacatactt gtagatcata tcgaggatct tttttgtctt
6661 tagaaaagat tggtctattg tctttggata tgaatctgca agagtttttcc cttttaaatc
6721 ataatctaat cctagatgcg attaaaaaag tttcctctgc caagacttct tggaccgaag
6781 gtactaaaca agttcgagca gcaagctata aagattccta aacaggatga
6841 ctaaggaat agtcgctata gcgcaaccct ctaaacaaga aaatagtcga acatttttta
6901 aaaccaggga aatagtaaaa acggatgcga tgaacagttt gcaaacagca tccttcctaa
6961 aagagctaaa aaaatcaac gcccgggatt ggttgatcgc ccagacaatg ctccaaggag
7021 gtaaacgctc ctctgaagtc ttaagcttgg agattagtca gatttgtttc caacaagcta
7081 ccattcttt ctcccagctt aagaaccgtc agacagaaa aggattatt ataacttatc
7141 ctcagaagtt tatgcactt ctacaagagt acatcggtca acgaagaggt tttgtcttcg
7201 taactcgctc cggaaaaatg gtggggttaa ggcaaatcgc ccgcacgttc tctcaagcag
7261 gactacaagc tgcaatccct tttaagataa cctttcgagca accgctgtga
7321 cggagtacaa acgcctaggg tgctcagact gaaggtcacg ggacacgcaa
7381 ccgcaaagat gatatttgcg tacgataaat cctctcgaga agacaacgct tcaaagaaga
7441 tggctctaat atagcctaaa ggtgttttt ctggcaacag
```

FIG. 27B

Corresponding Amino Acid Sequence of Pgp1 (SEQ ID NO: 207):

MKTRSEIENRMQDIEYALLGKALIFEDSTEYILRQLANYEFKCSHHKNIFIVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKINLI
ANQIQLLRKEDRVDVIFIDYLQLINSSVGENRQNEIADISRTIRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 27C

Corresponding Amino Acid Sequence of Pgp2 (SEQ ID NO: 208):

MVNYSNCHFIKSPIHLENQKFGRRPGQSIKISPKLAQNGMVEVIGLDFLSSHYHALAAIQRLLTATNYKGNTKGVILSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLLLNVNVKSLAYILRMNRYICTRNWKKIELAIDKCIEIAIQLGWLSRKKRIEFL
DSSKLSKKEILYLNKERFEEITKKSKEQMEQLEQESIN

FIG. 27D

Corresponding Amino Acid Sequence of Pgp3 (SEQ ID NO: 209):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 27E

Corresponding Amino Acid Sequence of Pgp4 (SEQ ID NO: 210):

MQNKRKVRDDFIKIVKDVKKDFPELDLKIRVNKEKVTFLNSPLELYHKSVSLLIGLLQQIENSLGLFPDSPVLEKLEDN
SLKLKKALIMLILSRKDMFSKAE

FIG. 27F

Corresponding Amino Acid Sequence of Pgp5 (SEQ ID NO: 211):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKFLNEYCAPFYDICIIDTPPSLGGLTKEAFVAGDKLIVCLTPEPFSILGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 27G

Corresponding Amino Acid Sequence of Pgp6 (SEQ ID NO: 212):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIICSGVSLSSYNENLLQ
QLFELFKQKS

FIG. 27H

Corresponding Amino Acid Sequence of Pgp7 (SEQ ID NO: 213):

MVKKMGSMAFHKSRLFLTFGDASEIWLSTLSHLTRKNYASGINFLVSLEILDLSETLIKAISLDHSESLFKIKSLDVFN
GKVVSEASKQARAACYISFTKFLYRLTKGYIKPAIPLKDFGNTTFFKIRDKIKTESISKQEMTVFFEALRIVNYRDYLI
GKLIVQGIRKLDEILSLRTDDLFFASNQISFRIKKRQNKETKLITFPISLMEELQKYTCGRNGRVFVSKIGIPVTTSQ
VAHNFRLAEFHSAMKIKITPRVLRASALIHLKQIGLIKDEEIMRISCLSSRQSVCSYCSGEEVSPLVQTPTIL

FIG. 27I

Corresponding Amino Acid Sequence of Pgp8 (SEQ ID NO: 214):

MRIGYITRDFMGKGILSLQQEMSLEYSEKSYQEVLKIRQESYWKRMKSFSLFEVIMHWTASLNKHTCRSYRGSFLSLEK
IGLLSLDMNLQEFSLLNHNLILDAIKKVSSAKTSWTEGTKQVRAASYISLTRFLNRMTQGIVAIAQPSKQENSRTFFKT
REIVKTDAMNSLQTASFLKELKKINARDWLIAQTMLQGGKRSSEVLSLEISQICFQQATISFSQLKNRQTEKRIITYP
QKFMHFLQEYIGQRRGFVFVTRSGKMVGLRQIARTFSQAGLQAAIPFKITPHVLRATAVTEYKRLGCSDSDIMKVTGHA
TAKMIFAYDKSSREDNASKKMALI

FIG. 28A

Nucleic Acid Sequence of Plasmid NC_012629 (SEQ ID NO: 215):

```
   1 tttgcaactc ttggtggtag actttgcaac tcttggtggt agactttgca actcttggtg
  61 gtagactttg caactcttgg tggtagactt ggtcataatg gactttttgtt aaaaatttc
 121 ttaaaatctt agagctccga ttttgaatag cttggttaa gaaaatgggc tcgatggctt
 181 tccataaaag tagattgttc ttaactttg gggacgcgtc ggaaatttgg ttatctactt
 241 tatctcatct aactagaaaa aattatgcgt ctgggattaa ctttcttgtt tctttagaga
 301 ttctggattt atcggaaacc ttgataaagg ctatttctct tgaccacagc gaatcttgt
 361 ttaaaatcaa gtctctagat gttttttaatg gaaaagtcgt ttcagaggcc tctaaacagg
 421 ctagagcggc atgctacata tctttcacaa agttttttgta tagattgacc aaggatata
 481 ttaaacccgc tattccattg aaagattttg gaaacactac atttttttaa atccgagaca
 541 aaatcaaaac agaatcgatt tctaagcagg aatgacagt tttttttgaa gcgctccgga
 601 tagtgaatta tagagactat ttaatcggta aatgattgt acaaggatc cgtaagttag
 661 acgaaatttt gtctttgcgc acagacgatc tatttttgc atccaatcag atttccttc
 721 gcattaaaaa aagacagaat aagaaaccaa aaattctaat cacattcct atcagcttaa
 781 tggaagagtt gcaaaaatac acttatggga gaaatgggag agtatttgtt tctaaaatag
 841 ggattcctgt aacaacaagt caggttgcgc ataattttag gcttgcagag ttccatagtg
 901 ctatgaaaat aaaaattact cccagagtac ttcgtgcaag cgcttttgatt catttaaagc
 961 aaataggatt aaaagatgag gaaatcatgc gtatttcctg tctctcatcg agacaaagtg
1021 tgtgttctta ttgttctggg gaagaggtaa gtcctctagt acaaacaccc acaatattgt
1081 gatataatta aattatatt catatctgt tgccagaaaa aaccctttta ggctatatta
1141 gagccatctt ctttgaagcg ttgtcttctc gagaggattt atcgtacgca aatatcatct
1201 ttgcggttgc gtgtcccgtg accttcatta tgtcggagtc tgagcaccct aggcgttgt
1261 actccgtcac agcggtttgct cgaagcacgt gcggggcga tttgccttaa ccccaccatt attgcagctt
1321 gtagtcctgc ttgagagaac cgtgcgggcga ctttgcctta ccccaccatt tttccggagc
1381 gagttacgaa gacaaaacct cttcgttgac cgatgtactc ttgtagaaag attgcagctt
1441 tctgaggata agttataata atcctctttt ctgtctgacg gttcttaagc tgcataaact
1501 aaatggtagc ttgtttggaaa caaatctgac taatctccaa gcttaagact tgggagaaag
1561 gtttacctcc ttggagcatt gtctggggcga tcaaccaatc ccgggcgttg atttttttta
```

FIG. 28A (cont.)

```
1621 gctcttttag gaaggatgct gtttgcaaac tgttcatcgc atccgttttt actatttccc
1681 tggttttaaa aaatgttcga ctattttctt gtttagaagg ttgcgctata gcgactattc
1741 cttgagtcat cctgtttagg aatcttgtta aggaaatata gcttgctgct cgaacttgtt
1801 tagtaccttc ggtccaagaa gtcttggcag aggaaacttt tttaatcgca tctaggatta
1861 gattatgatt taaaagggaa aactcttgca gattcatatc caaagacaat agaccaatct
1921 tttctaaaga caaaaaagat cctcgatatg atctacaagt atgtttgttg agtgatgcgg
1981 tccaatgcat aataacttcg aataaggaga agcttttcat gcgtttccaa taggattctt
2041 ggcgaatttt taaacttcc tgataagact tttcgctata ttctaacgac atttcttgct
2101 gcaaagataa aatccctta cccatgaaat ataacctatc cgcaaaatgt
2161 cctgattagt gaaataatca ggttgttaac gctcggtatt tttttatata
2221 aacatgaaaa ctcgttccga aatagaaaat atatcgagta tgcgtttgtta
2281 ggtaaagctc tgatatttga agactctact gaggcagct tgctaattat aaaagacaat
2341 gagtttaagt gttcccatca taaaacata ttcatagtat ttaaatactt tatcaaagat
2401 ggattaccta taactgtaga ctcggcttgg gaagagcttt tgcggcgtcg caagcttaga
2461 atggacaaat cgtatctcgg gttaatgttg catgatgctt tatcaaatga agaaaatttg
2521 tccgttctc atacggtttt cctcgatgat ttgagcgtgt gtagcgctga agacatggcg
2581 agcaatttca ttttccgctc gttaatgag tacaatgaaa atccattgcg tagatctccg
2641 tttctattgc ttgagcgtat aaaggaagg cttgatagtg ctatagcaaa gactttttct
2701 attcgcagcg ctagaggccg gtctatttat gatatattct cacagtcaga aattggagtg
2761 ctgctcgta taaaaaaaag acgagcagcg atcaaattc tttctttgat
2821 gcttcccaa cgggatacaa ggatattgat gataaggag ttatcttagc taaaggtaat
2881 ttcgtgatta tagcagctag gccatctata gggaaaacag cttagctat agacatggcg
2941 ataaatcttg cggttactca acagcgtaga gttggtttcc tatctctaga aatgagcgca
3001 ggtcaaattg ttgagcggat tattgctaaa ttaacaggaa tatctggtga aaaattacaa
3061 agaggggatc tctctaaaga agaattattc cgagtagaag aagctgtaga aacagttaga
3121 gaatcacatt tttatatctg cagtcgatagt cagtataagc ttaatttaat cgcgaatcag
3181 atccagttgc tgagaaaaga agatcgagta gacgatatat ttatcgatta cttgcagttg
3241 atcaactcat cggttggaga aaatcgtcaa aatgaaatag cagatatatc tagaacctta
```

FIG. 28A (cont.)

```
3301 agagtttag cctcagagct aaacattcct atagttttgtt tatccaact atctagaaaa
3361 gttgaggata gagcaaataa agttcccatg ctttcagatt cttccagacag cggtcaaata
3421 gagcaagacg cagatgtgat tttgttttatc aatagaaagg aatcgtcttc taattgtgag
3481 ataactgttg ggaaaaatag acatggatcg gttttctctt cggtattaca tttcgatcca
3541 aaaattagta aattctccgc tattaaaaaa gtatggtaaa ttatagtaac tgccacttca
3601 tcaaaagtcc tatccaccctt gaaaatcaga agtttggaag aagacctggt caatctatta
3661 agatatctcc caaattggct caaaatggga tggtagaagt tataggtctt gatttttctt
3721 catctcatta ccatgcatta gcagctatcc aaagattact gaccgcaacg aattacaagg
3781 ggaacacaaa agggttatt ttatccagag aatcaaatag ttttcaattt gaaggatgga
3841 taccaagaat ccgttttaca aaaactgaat tcttagaggc ttatggagtt aagcggtata
3901 aaacatccag aaataagtat gagtttagtg gaaaagaagc tgaaactgct ttagaagcct
3961 tataccatttt aggacatcaa ccgtttttaa tagtgcaac tagaactcga tggactaatg
4021 gaacacaaat agtagaccgt taccaaactc tttctccgat cattaggatt tacgaaggat
4081 gggaagtttt aactgacgaa gaaaatatag atatagactt aacaccttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgttcccaa
4261 atgcatcaaa gtatgcttac acattatcg actgggtgat tatacccagct gcgaaaaaga
4321 gacgaaaatt aactaaggat aattcttggc cagaaaactt gttattaaac gttaacgtta
4381 aaagtcttgc atatattta aggatgaatc ggtacatctg tacaaggaac tggaaaaaaa
4441 tcgagttagc tatcgataaa tgtatagaaa tcgccattca gcttggctgg ttatctagaa
4501 gaaaacgtat tgaattctg gattcttcta aactctaaga aaagaaatt ctatatctaa
4561 ataaagagcg ctttgaagaa ataactaaga tgtatagaga acaatggaa caattagaac
4621 aagaatctat taattaatag caagcttgaa actaaaaacc taatttattt aaagctcaaa
4681 atataaaaga ctttaaaat gggaaattct ggttttttatt tgtataacac tgaaaactgc
4741 gtctttgctg ataatatcaa agttgggcaa atgacagagc cgctcaagga ccagcaaata
4801 atcctttgga caacatcaac acctgtcgca gccaaaatga cagcttctga tggaatatct
4861 ttaacagtct ccaataattc atcaaccaat gcttctatta caattggttt ggatgcggaa
4921 aaagcttacc agcttattct agaaaagttg ggagatcaaa ttcttgatgg aattgctgat
```

FIG. 28A (cont.)

```
4981  actattgttg ataatacagt ccaagatatt ttagacaaaa tcaaaacaga cccttctcta
5041  ggtttgttga aagcttttaa caactttcca atcactaata aaattcaatg caacgggtta
5101  ttcactccca gtagcattga aactttatta ggaggaactg aaataggaaa attcacagtc
5161  acacccaaaa gctctggag catgttctta gtctcagcag atattattgc atcaagaatg
5221  gaaggcggcg ttgttctagc tttggtacga gaaggtgatt ctaagccctg cgcgattagt
5281  tatggatact catcaggcgt tcctaattta tgtagtctaa gaaccagcat tactaataca
5341  ggattgactc caacaacgta ttcattacgt gtaggcggtt tagaaagcgg tgtggtatgg
5401  gttaatgccc tttctggaag caatgatatt ttaggaataa caaatacttc taatgtatct
5461  tttttggaag taatacctca aacaaacgct ttaggatt ttattggatt tttcttatag
5521  gttttatatt tagagaaaac agtcgaatt acggggtttg ttatgcaaaa taaaagaaaa
5581  gtgagggacg attttattaa aatgttaaa gatgtgaaaa aagatttccc cgaattagac
5641  ctaaaaatac gagtaaacaa ggaaaaagta actttcttaa attctcccctt agaactctac
5701  cataaaagtg tctcactaat tctaggactg cttcaacaaa tagaaaactc tttaggatta
5761  ttcccagact ctcctgttct tgaaaaatta gaggataaca gtttaaagct aaaaaaggct
5821  ttgattatgc ttatcttgtc tagaaaagac atgttttcca aggctgaata gacaacttac
5881  tctaacgttg gagttgattt gcacacctta gttttttgct cttttaaggg aggaactgga
5941  aaaacaaacac atttatttaa cgtgggatgc aacttggccc aatttttagg gaaaaaaagtg
6001  ttacttgctg acctagaccc gcaatccaat ttatcttctg gattggggc tagtgtcaga
6061  agtaaccaaa aaggcttgca cgacatagta tacacatcaa acgattaaa atcaatcatt
6121  tgcgaaacaa aaaaagatag tgtggaccta attcctgcat catttttatc cgaacagttt
6181  agagaattgg atattcatag aggacctagt aacaacttaa agttatttct gaatgagtac
6241  tgcgctcctt tttatgacat ctgcataata gacactccac ctagcctagg agggttaacg
6301  aaagaagctt ttgttgcagg agacaatta attgtttgtt taactccaga acctttttct
6361  attctagggt tacaaaagat acgtgaattc ttaagttcgg tcgaaaaacc tgaagaagaa
6421  cacattcttg gaatagcttt gtcttttttgg gatgatcgta actcgactaa ccaaatgtat
6481  atagacatta tcgagtctat ttacaaaaac aagctttttt caacaaaaat tcgtcgagat
6541  atttctctca gccgttctct tcttaaagaa gattctgtag ctaatgtcta tccaaattct
6601  aggccgcag aagatattct catgaaatag caaatatttt gcatatcgaa
```

FIG. 28A (cont.)

```
6661 tatgaacgag attactctca gaggacaacg tgaacaaact aaaaaaagaa gcggatgtct
6721 tttttaaaaa aaatcaaact gccgcttctc tagattttaa gaagacactt cctccattg
6781 aactattctc agcaactttg aattctgagg aaagtcagag tttggatcga ttatttttat
6841 cagagtccca tgcttactat cg gatgaagaat tttatcaaga agacatccta gcggtaaaac
6901 tgcttactgg tcagataaaa agcaacacgt acttctttta ggagaaaaaa
6961 tctataatgc tagaaaaatc ctgagtaagg atcacttctc ctcaacaact tttt catctt
7021 ggatagagtt agttttttaga actaagtctt ctgcttacaa tgctcttgca tattacgagc
7081 tttttataaa cctccccaac caaactctac aaaaagagtt tcaatcgatc cctatagga
7141 ccgcatatat tttggccgct agaaaaaggcg atttaaaaac caaggtcgat gtgataggga
7201 aagtatgtgg aatgtcgaac tcatcggcga taagggtgtt ggatcaattt cttccttcat
7261 ctagaaacaa agacgttaga gaaacgataa tactccgca ataagtctga ttcagagaag aatcgccaat
7321 tatctgattt cttaatagag cttatcttcg cca tcatatgttc cggagtttct ttgtcctcct
7381 ataacgaaaa tcttctacaa cagctttttg aacttttta aa gcaaaagagc tgatcctccg
7441 tcagctcata tatatatta ttatatat atttatttag ggatttgatt ttacgagaga
7501 gagcac
```

FIG. 28B

Corresponding Amino Acid Sequence of Pgp1 (SEQ ID NO: 216):

MKTRSEIENRMQDIEYALLGKALIFEDSTEYILRQLANYEFKCSHHKNIFTVFKYLKDNGLPITVDSAWEELLRRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIQLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 28C

Corresponding Amino Acid Sequence of Pgp2 (SEQ ID NO: 217):

MVNYSNCHFIKSPIHLENQKFGRRPGQSIKISPKLAQNGMVEVIGLDFLSSHYHALAAIQRLLTATNYKGNTKGVILSR
ESNSFQFEGWIPRIRFTKTFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRKLTKDNSWPENLLLNVNVKSLAYILRMNRYICTRNWKKIELAIDKCIEIAIQLGWLSRKKRIEFL
DSSKLSKKEILYLNKERFEEITKKSKEQMEQLEQESIN

FIG. 28D

Corresponding Amino Acid Sequence of Pgp3 (SEQ ID NO: 218):

MGNSGFYLYNTENCVFADNIKVGQMTEPLKDQQIILGTTSTPVAAKMTASDGISLTVSNNSSTNASITIGLDAEKAYQL
ILEKLGDQILDGIADTIVDNTVQDILDKIKTDPSLGLLKAFNNFPITNKIQCNGLFTPSSIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 28E

Corresponding Amino Acid Sequence of Pgp4 (SEQ ID NO: 219):

MQNKRKVRDDFIKIVKDVKKDFPELDLKIRVNKEKVTFLNSPLELYHKSVSLLIGLLQQIENSLGLFPDSPVLEKLEDN
SLKLKKALIMLILSRKDMFSKAE

FIG. 28F

Corresponding Amino Acid Sequence of Pgp5 (SEQ ID NO: 220):

MHTLVFCSFKGGTGKTTLSLNVGCNLAQFLGKKVLLADLDPQSNLSSGLGASVRSNQKGLHDIVYTSNDLKSIICETKK
DSVDLIPASFLSEQFRELDIHRGPSNNLKFLNEYCAPFYDICIIDTPPSLGGLTKEAFVAGDKLIVCLTPEPFSILGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 28G

Corresponding Amino Acid Sequence of Pgp6 (SEQ ID NO: 221):

MNKLKKEADVFFKKNQTAASLDEKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIICSGVSLSSYNENLLQ
QLFELFKQKS

FIG. 28H

Corresponding Amino Acid Sequence of Pgp7 (SEQ ID NO: 222):

MGSMAFHKSRLFTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTYGRNGRVFVSKIGIPVTTSQVAHN
FRLAEFHSAMKIKITPRVLRASALIHLKQIGLKDEEIMRISCLSSRQSVCSYCSGEEVSPLVQTPTIL

FIG. 28I

Corresponding Amino Acid Sequence of Pgp8 (SEQ ID NO: 223):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

FIG. 29A

Nucleic Acid Sequence of Plasmid CP002053 (SEQ ID NO: 224):

```
   1  aatatgaata taattttaat tatatcacaa tattgtgggt gtttgtacta gaggacttac
  61  ctcttcccca gaacaataag aacacacact ttgtctcgat gagagacagg aaatacgcat
 121  gatttcctca tcttttaatc ctatttgctt taaatgaatc aaagcgcttg cacgaagtac
 181  tctgggagta attttatttt tcatagcact atggaactct gcaagcctaa aattatgcgc
 241  aacctgactt gttgttacag gaatccctat tttagaaaca aatactctcc cattctcccc
 301  acaagtgtat ttttgcaact cttccattaa gctgatagga aatgtgatta gaatttttggt
 361  ttctttattc tgtctttttt taatgcgaaa ggaaatctga ttggatgcaa aaaatagatc
 421  gtctgtgcgc aaagacaaaa tttcgtctaa cttacggatc cccttgtacaa tcaatttacc
 481  gattaaatag tctctataat tcactatccg gagcgcttca aaaaaaactg tccattcctg
 541  cttagaaatc gattctgttt tttttttgtc tcccttggtc aatctataca tgtttccaaa
 601  atctttcaat ggaatagcgg gttaatata tccctggtc aatctataca aaaactttgt
 661  gaaagatatg tagcatgccg ctctagcctg tttagaggcc tctgaaacga cttttccatt
 721  aaaaacatct agagacttga ttttaaacaa agattcgctg tggtcaagag aaatagcctt
 781  tatcaaggtt tccgataaat ccagaatctc taaagaaaca agaaagttaa tcccagacgc
 841  ataatttttt ctagttagat gagataaagt agataaccaa atttccgacg cgtcccaaa
 901  agttagaac aatctacttt tatggaaagc catcgagccc atttcttaa ccaaagctat
 961  tcaaatcgg agctctaaga ttttaagaaa ttttttaaca aaagtccatt atgaccaagt
1021  ctaccaccaa gagttgcaaa gtctaccacc aagagttgca aagtctacca ccaagagttg
1081  caaagtctac caccaagagt tgcaaatccct tcaaatccct aaatccct aaaataaata
1141  atatataata aatatatata tgagctgacg gaggatcagc tcttttgctt aaaaagttca
1201  aaaagctgtt gtagaagatt ttcgttatag gaggacaaag aaactccgga acatatgatg
1261  cgaagtatct ctattaagaa atcagataat tggcgattct tctctaaatc agacttatct
1321  atcgtttctc taacgtcttt gtttctagat gaaggaagaa attgatccaa caccctatc
1381  gccgatgagt tcgacattcc acatactttc cctatcacat cgaccttggt ttttaaatcg
1441  ccttttctag cggccaaaat atatgcggat ttataggggga tcgattgaaa ctctttttgt
1501  agagtttggt tggggaggtt tataaaaagc tcgtaatatg caagagcatt gtaagcagaa
1561  gacttagttc taaaaactaa ctctatccaa gatgaaaaag ttgttgagga gaagtgatcc
```

FIG. 29A (cont.)

```
1621  ttactcagga  tttttctagc  attatagatt  ttttctccta  aaagaagtac  gtgttgcttc
1681  tgtatggatt  ttatctgacc  agtaagcagt  tttaccgcta  ggatgtcttc  ttgataaaat
1741  tcttcatccg  aatagttttg  ggactctgat  aaaaataatc  gatccaaact  ctgactttcc
1801  tcagaattca  aagttgctga  gaatagttca  atggaaggaa  gtgtctctt  aaaatctaga
1861  gaagcggcag  tttgatttt   tttaaaaaag  acatccgctt  cttttttag   tttgttcacg
1921  ttgtctctg   agagtaatct  cgttcatatt  cgatatgcaa  aatatttgct  atttcatgcg
1981  ttaacttcag  aatatcttct  gcggccctag  aatttggata  gacattagct  acagaatctt
2041  ctttaagaaag agaacggctg  agagaaatat  ctcgacgaat  ttttgttgaa  aaaagcttgt
2101  ttttgtaaat  agactcgata  atgtctatat  acatttggtt  agtcgagtta  cgatcatccc
2161  aaaaagacaa  agctattcca  agaatgtgtt  cttcttcagg  ttttccgacc  gaacttaaga
2221  attcacgtat  ctttttgtaac cctagaatag  aaaaaggttc  tggagttaaa  caagcaatta
2281  atttgtctcc  tgcaacaaaa  gcttctttcg  ttaacctcc   taggctaggt  ggagtgtcta
2341  ttatgcagat  gtcatataa   ggagcgcagt  actcattcag  aaataacttt  aagttgttac
2401  taggtcctct  atgaatatcc  aattctctaa  actgttcgga  taaaatgat   gcaggaatta
2461  ggtccacact  atctttttt   gtttcgcaaa  tgattgattt  taatcgttt   gatttgtata
2521  ctatgtcgtg  caagccttt   tggttattc   tgacactagc  cccaatccca  gaagataaat
2581  tggattgcgg  gtctaggtca  gcaagtaaca  ctttttccc   taaaaattgg  gccaagttgc
2641  atcccacgtt  tagagaaagt  gttgttttc   cagttcctcc  cttaaaagag  caaaaaacta
2701  aggtgtgcaa  atcaactcca  acgttagagt  aagtttgtcta ttcagccttg  gaaaacatgt
2761  cttttctaga  caagataagc  ataatcaaag  cctttaaactg ctttaaactg  ttatcctcta
2821  atttttcaag  aacaggagag  tctgggaata  atccctaaaga gttttctatt  tgttgaagca
2881  gtcctagaat  tagtgagaca  ctttatggt   agagtctaa   gggagaattt  aagaaagtta
2941  ctttttcctt  gtttactcgt  attttttaggt ctaattcggg  gaaatctttt  ttcacatctt
3001  taacaattt   aataaaatcg  tccctcactt  ttctttattt  ttgcataaca  aacccgtaa
3061  ttcgaactgt  tttctctaaa  tataaaacct  ataagaaaaa  tccaataaaa  attgtttaag
3121  cgtttgtttg  aggtattact  tccaaaaagg  ataacattaga agtattgtt  attcctaaa
3181  tatcattgcc  attagaaagg  gcattaacct  ataccacacc  gctttctaaa  ccgcctacac
3241  gtaatgaata  cgttgttggt  gtcaatcctg  tattagtaat  gctgttttctt agactacata
```

FIG. 29A (cont.)

```
3301 aattaggaac gcctgatgag tatccataac taatcgcgca gggcttagaa tcaccttctc
3361 gtaccaaagc tagaacaacg ccgccttcca ttcttgatgc aataatatct gctgagacta
3421 agaacatgct cccagagctt ttgggtgtga ctgtgaattt tcctatttca gttcctccta
3481 ataaagtttc aatgttactg ggagtgaata acccgttgca ttgaattta ttagtgattg
3541 gaaagttgtt aaaagctttc aacaaaccta gagaagggtc tgttgtgatt ttgtctaaaa
3601 tatcttggac tgtactatca acaatagtat cagcaattcc atcaagaatt tgatttccca
3661 actttctag aataagctgg taagctttt ccgcatccaa accaattgta atagaagcat
3721 tggtttgatga attattggag actgttaaag atattccatc agaagctgtc attttggctg
3781 cgacaggtgt tgattttgtc ccaaggatta tttgctggtc cttgagcggc tctgtcattt
3841 gcccaacttt gatattatca gcaagacgc gttatacaaa taaaaaccag
3901 aatttcccat ttaaaactc ttttttattt tgagcttaa ataaattagg tttttagttt
3961 caagcctgct attaattaat agattcttgt tccattgtt cttagattt cttagttatt
4021 tcttcaaagc gctcttatt tagatataga attttcttt tagagagttt agaagaatcc
4081 agaaattcaa tgcgttttct tctagataac cagccaagct gaatggcgat ttctatacat
4141 ttatcgatag ctaactcgat ttttttccag ttccttgtac agtttctgg attcatcctt
4201 aaaatatatg caagactttt aacgttaacg tttaataaca agtttctgg ccaagatta
4261 tccttagtta atttcgtct ctttttcgca ctgctgtaa tcacccagtc gataaatgtg
4321 taagcatact ttgatgcgtt tggaaacgc attttttattt cttggtatac atttgcaggc
4381 ttgattacaa agtaggattc tatttgatct accaagatag gacatgctc tacaacgaat
4441 cctttatgtt tccgtgtaga tggtgaatta aaaggtgtta agtctatatc tatattttct
4501 tcgtcagtta aaccttccca tccttcgtaa atcctaatga tcggagaaag agtttggtaa
4561 cggtctacta tttgtgttcc attagtccat cgagttctag ttgccactat taaaaacggt
4621 tgatgtccta aatggtacaa ggcttctaaa gcagtttcag cttctttcc actaaactca
4681 tacttatttc tggatgtttt atggtgtat actccaagaa cctctaagaa ttcagttttt
4741 gtaaaacgga ttcttggtat ccatccttca aatttgattc tatttgattc tctggataaa
4801 acaacccctt ttgtgttccc cttgtaattc gttgcggtca gtaatctttg gatagctgct
4861 aatgcatggt aatgagatga agaccttata cttctaccat cccattttga
4921 gccaatttgg gagatatctt aatagattga ccaggtcttc ttccaaactt ctgatttca
```

FIG. 29A (cont.)

```
4981  aggtggatag gactttgat gaagtggcag ttactataat ttaccatact tttttaatag
5041  cggagaattt actaattttt ggatcgaaat gtaataccga agagaaaacc gatccatgtc
5101  tatttccc aacagttatc tcacaattag aagacgattc cttcctattg ataaacaaaa
5161  tcacatctgc gtcttgctct atttgaccgc tgtctcgcaa atctgaaagc atggaactt
5221  tattgctct atcctcaact tttctagata gttgggataa acaaactata ggaatgttta
5281  gctctgaggc taaacctctt aaggttctag atatatctgc tattttcattt tgacgatttt
5341  ctccaaccga tgagttgatc aactgcaagt aatcgataaa tattacgtct actcgatctt
5401  cttttctcaa caaccggatc tgattcgcga ttaaattaag cttatactga ctatcactgc
5461  agatataaaa atgtgattct ctccagcttc ttccactcgg aataattctt
5521  ctttagagag atccccctctt tgtaatttt caccagatat tcctgttaaa ttagcaacaa
5581  tcgctcaac aatttgacct gcgctcattg ctagagatag gaaaccaact ctacgctgtt
5641  gagtaaccgc aagatttatc gccatgtcta tagctaagc tgttttccct atagatggcc
5701  tagctgctat aatcacgaaa ttaccttag ctaagataac tccttatca tcaatatcct
5761  tgtatcctgt tgggaagcca tcaaagaaag aatttgatt ctcagaaac gctgctcgtc
5821  ttttttat acgagccagc actccaattt ctgactgtga gaatatatca taaatagacc
5881  ggcctctagc gctgcaata gaaaaagtct ttgctatagc acaatcaagc cttcccttta
5941  tacgctcaag caatagaaac ggagatctac gcaatggatt ttcattgtac tcattaaacg
6001  agcggaaaat gaaattgctc aaattttctt cagcgctaca cacgctcaaa tcatcgagga
6061  aaaccgtatg agaaacggat ctaagcttgt catttgataa agcatcatgc aacattaacc
6121  cgagatacga tttgtccata tcttttgata gacgccgcaa agctcttcc caagcgagt
6181  ctacagttat agtaatcca ttgtctttta agtattttaaa tactatgaat atgttttat
6241  gatgggaaca cttaaactca aattagcaa gctgcctcag aatatactca gtagagtctt
6301  caaatatcag agcttacct actttcatgt actcgatatc actcgatatc ttgcatgcga ttttctattt
6361  cggaacgagt tttcatgttt atataaaaaa ataccgagcg tgcatcctg ttaacaacct
6421  gattattca ctaatcagga catttgcgg ataggttata tgctatccg tttcatgggt
6481  aaaggattt tatctttgca gcaagaaatg tcgttagaat atagcgaaaa gtcttatcag
6541  gaagttttaa aaattcgcca agaatcctat tggaaacgca tgaaagctt ctccttattc
6601  gaagttatta tgcattggac cgcatcactc aacaaacata cttgtagatc atatcgagga
```

FIG. 29A (cont.)

```
6661 tctttttgt ctttagaaaa gattggtcta ttgtctttgg atatgaatct gcaagagttt
6721 tcccttttaa atcataatct aatcctagat gcgattaaaa aagtttcctc tgccaagact
6781 tcttggaccg aagtactaa acaagttcga gcagcaagct atattcctt aacaagattc
6841 ctaaacagga tgactcaagg aatagtcgct atagcgcaac cttctaaaca agaaaatagt
6901 cgaacatttt ttaaaaccag ggaaatagta aaaacggatg cgatgaacag tttgcaaaca
6961 gcatccttcc taaaagagct aaaaaaaatc aacgcccggg attggttgat cgcccagaca
7021 atgctccaag gaggtaaacg ctcctctgaa gtcttaagct tggagattag tcagatttgt
7081 ttccaacaag ctaccatttc ctttatcgaa gtcagaacc gtcagacaga aaagaggatt
7141 attataactt atcctcagaa gtttatgcac cttctacaag agtacatcgg tcaacgaaga
7201 ggttttgtct tcgtaactcg ctccggaaaa atggtggggt taaggcaaat cgcccgcacg
7261 ttctctcaag caggactaca agctgcaatc cctttaaga taaccccgca cgtgctttcga
7321 gcaacgcgtg tgacggagta caaacgccta gggtgctcag actccgacat aatgaaggtc
7381 acgggacacg caaccgcaaa gatgatattt gcgtacgata aatcctctcg agaagacaac
7441 gcttcaaaga agatggctct atatagcct aaggtgttt tttctggcaa cag
```

FIG. 29B

Corresponding Amino Acid Sequence of Pgp1 (SEQ ID NO: 225):

MKTRSEIENRMQDIEYALLGKALIFEDSTEYILRQLANYEFKCSHHKNIFIVFKYLKDNGLPITVDSAWEELLRRIKD
MDKSYLGLMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRAAFSENQNSFFDGFPTGYKDIDDKGVILAKGNFVIIAARPSIGKTALAID
MAINLAVTQQRRVGFLSLEMSAGQIVERIVANLTGISGEKLQRGDLSKEELFRVEEAGETVRESHFYICSDSQYKLNLI
ANQIRLLRKEDRVDVIFIDYLQLINSSVGENRQNEIADISRTLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 29C

Corresponding Amino Acid Sequence of Pgp2 (SEQ ID NO: 226):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWITAAKKRRKLTKDNSWPENLLLNVNVKSLAYILRMNRYICTRNWKKIELAIDKCIEIAIQLGWLSRRKRIEFL
DSSKLSKREILYLNKERFEEITKKSKEQMEQESIN

FIG. 29D

Corresponding Amino Acid Sequence of Pgp3 (SEQ ID NO: 227):

MGNSGFYLYNTENCVFADNIKVGQMTEPLKDQQIILGTKSTPVAAKMTASDGISLTVSNNSSTNASITIGLDAEKAYQL
ILEKLGNQILDGIADTIVDSTVQDILDKITDPSLGLLKAFNNFPITNKIQCNGLFTPSNIETLLGGTEIGKFTVTPKS
SGSMFLVSADIIASRMEGGVVLALVREGDSKPCAISYGYSSGVPNLCSLRTSITNTGLTPTTYSLRVGGLESGVVWVNA
LSNGNDILGITNTSNVSFLEVIPQTNA

FIG. 29E

Corresponding Amino Acid Sequence of Pgp4 (SEQ ID NO: 228):

MQNKRKVRDDFIKIVKDVKKDFPELDLKIRVNKEKVTFLNSPLELYHKSVSLLIGLLQQIENSLGLFPDSPVLEKLEDN
SLKLKKALIMLILSRKDMFSKAE

FIG. 29F

Corresponding Amino Acid Sequence of Pgp5 (SEQ ID NO: 229):

MHTLVFCSFKGGTGKTTLSLNVGCNLAQFLGKKVLLADLDPQSNLSSGLGASVRNNQKGLHDIVYKSNDLKSIICETKK
DSVDLIPASFLSEQFRELDIHRGPSNNIKLFLNEYCAPFYDICIIDTPPSLGGLTKEAFVAGDKLIACLTPEPFSILGL
QKIREFLSSVGKPEEEHILGIALSFWDDRNSTNQMYIDIIESIYKNKLFSTKIRRDISLSRSLLKEDSVANVYPNSRAA
EDILKLTHEIANILHIEYERDYSQRTT

FIG. 29G

Corresponding Amino Acid Sequence of Pgp6 (SEQ ID NO: 230):

MNKLKKEADVFFKKNQTAASLDFKKTLPSIELFSATLNSEESQSLDRLFLSESQNYSDEEFYQEDILAVKLLTGQIKSI
QKQHVLLGEKIYNARKILSKDHFSSTTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDLEKNRQLSDFLIEILRIICSGVSLSSYNENLLQ
QLFELFKQKS

FIG. 29H

Corresponding Amino Acid Sequence of Pgp7 (SEQ ID NO: 231):

MVKKMGSMAFHKSRLFLTFGDASEIWLSTLSHLTRKNYASGINFLVSLEILDISETLIKAISLDHSESLFKIKSLDVEN
GKVVSEASKQARAACYISFTKFLYRLTKGYIKPAIPLKDFGNTFFEKIRDKIKTESISKQEWTVFFEALRIVNYRDYLI
GKLIVQGIRKLDEILSLRTDDLFFASNQISFRIKKRQNKETKILITEPISLMEELQKYTCGRNGRVFVSKIGIPVTTSQ
VAHNFRLAEFHSAMKIKITPRVLRASALIHLKQIGLKDEEIMRISCLSSRQSVCSYCSGEEVSPLVQTPTIL

FIG. 29I

Corresponding Amino Acid Sequence of Pgp8 (SEQ ID NO: 232):

MRIGYITRDFMGKGILSLQQEMSLEYSEKSYQEVLKIRQESYWKRMKSFSLFEVIMHWTASLNKHTCRSYRGSFLSLEK
IGLLSLDMNLQEFSLLNHNLILDAIKKVSSAKTSWTEGTKQVRAASYISLTRFLNRMTQGIVAIAQPSKQENSRTFFKT
REIVKTDAMNSLQTASFLKELKKINARDWLIAQTMLQGGKRSSEVLSLEISQICFQQATISFSQLKNRQTEKRIIITYP
QKFMHFLQEYIGQRRGFVFVTRSGKMVGLRQIARTFSQAGLQAAIPFKITPHVLRATAVTEYKRLGCSDSDIMKVTGHA
TAKMIFAYDKSSREDNASKKMALI

FIG. 30A

Nucleic Acid Sequence of Plasmid NC_010029 (SEQ ID NO: 233):

```
   1 tttgcaactc ttggtggtag actttgcaac tcttggtggt agactttgca actcttggtg
  61 gtagactttg caactcttgg tgtagactt ggtcatatg gtcatatgg tactttgtt gaaaatttc
 121 ttaaaatctt agagctccga ttttgaatag ctttggttaa gaaaatgggc tcgatggctt
 181 tccataaaag taggttgttc ttaactttg gggacgcgtc ggaaattgg ttatctactt
 241 tatctcatct aactagaaaa aattatgcgt ctggattaa cttctgtt tctttagaga
 301 ttctggattt atcggaaacc ttgataaagg ctatttctct tgaccacagc gaatctttgt
 361 ttaaaatcaa gtctctagat gttttaatg gaaaagtcgt ttcagaggcc tctaaacagg
 421 ctagagcggc atgctacata tctttcacaa agttttgta tagattgacc aagggatata
 481 ttaaacccgc tattccattg aaagattttg gaaacactac attttttaaa atccgagaca
 541 aaatcaaaac agaatcgatt tctaagcagg aatgacagt ttttttgaa atttttttaa gcgctccgga
 601 tagtgaatta tagagactat ttaatcggta acagacgatc tatttttgc acaaggatc cgtaagttag
 661 acgaaatttt gtctttgcgc acagacgaat aaagaaacca atcctaat atccaatcag atttccttc
 721 gcattaaaaa aagacagaat acttgtggga gaaatgggag agtattgtt atcagcttaa
 781 tggaggagtt gcaaaaatac actgtggga ataattttag gcttgcagag ttctatagtg
 841 ggattcctgt aacaacaagt caggttgcgc ttcgtgcaag cgctttgatt catttaaagc
 901 ctatgaaaat aaaaattact cctagagtac gtattccctg tctttcatcg agacaaagtg
 961 aaatagatt aaagagatgag gaaatcatgc gtatttcctg acaaacaccc ccaatattgt
1021 tgtgttctta ttgttctggg gaagaggtaa gtccctagt acaaacaccc ggctatatta
1081 gatataatta aattatatt catattctgt tgccagaaaa aacactttta ggctatatta
1141 gagccatctt ctttgaagcg ttgtcttctc gagaagatt atcgtacgca aatatcatct
1201 ttgcggttgc gtgtcctgtg accttcatta tgtcggagtc tgagcaccct aggcgttgt
1261 actccgtcac agcggttgct cgaagcacgt gcggggcga cttaaaagg attgcagctt
1321 gtagtcctgc ttgagagaac gtgcgggcga tttgccttaa ccccaccat tttccggagc
1381 gagttacgaa gacaaaacct cttcgttgac cgatgtactc ttgtagaaag tgcataaact
1441 tctgaggata agttataata ctgtctgacg taatctgac gcttaagct tgggagaaag
1501 aaatggtagc ttgttggaaa caaatctgac taatctccaa gcttaagact tcagaggagc
1561 gtttacctcc ttggagcatt gtctgggcga tcaaccaatc ccgggcattg atttttta
```

FIG. 30A (cont.)

```
1621 gctcttttag gaaggacgct gtttgcaaac tgttcatcgc atctgtttt actatttccc
1681 tgttttaaa aaatgttcga ctattttctt gtttagaagg ttgcgctata gcgactattc
1741 cttgagtcat cctgtttagg aatcttgtta aggaaatata gcttgctgct cgaacttgtt
1801 tagtacccttc ggtccaagaa gtcttggcag aggaaactt tttaatcgca tctagaatta
1861 gattatgatt taaaagggaa aactcttgca gattcatatc caaggacaat agaccaatct
1921 tttctaaaga caaaaaagat cctcgatatg atctacaagt atgtttgttg agtgatgcgg
1981 tccaatgcat aataacttcg aataaggaga agcttttcat gcgtttccaa taggattctt
2041 ggcgaatttt taaaacttcc tgataagact ttctgctata ttctaacgac atttcttgct
2101 gcaaagataa aatcccttta cccatgaaat ataacctatc cgtaaaatgt
2161 cctgattagt gaaataatca ggttgttaac gctcggtatt ttttatata
2221 aacatgaaaa ctcgttccga aatagaaaat atatcgagta tgcgttgtta
2281 ggtaaagctc tgatatttga agactctact gaggcagct tgctaattat
2341 gagtttaagt gttctcatca taaaacata ttcatagtat aaaagacaat
2401 ggattaccta taactgtaga ctcggcttgg gaagagcttc tatcaagctt aga
2461 atgacaaat cgtatctcgg gttaatgttg catgatgctt tgcggcgtcg caagcttaga
2521 tccgtttctc atacggtttt cctcgatgat ttgagcgtgt gtagcgctga agaaaatttg
2581 agtaatttca tttccgctc gtttaatgag tacaaggaa atccattgcg tagatctccg
2641 tttctattgc ttgagcgtat aaagggaagg cttgacagtg ctatagcaaa gactttttct
2701 attcgcagcg ctagaggccg gtctatttat gatatttat cacagtcaga aattggagtg
2761 ctgctcgta taaaaaaag acgagcaacg ttctctgaga atcaaaattc tttctttgat
2821 gccttcccaa caggatacaa ggatattgat gataaggag ttatcttagc taaaggtaat
2881 ttcgtgatta tagcagctag gccatctata gggaaaactg ctttagctat agacatgcg
2941 ataaatcttg cggttactca acagcgtaga gttggttttcc tatctctaga aatgagcgca
3001 ggtcaaattg ttgagcggat tattgctaat ttaacaggaa tatctggtga aaaattacaa
3061 agaggggatc tctctaaaga agaattattc cgagtagaag aagctggaga aacagttaga
3121 gaatcacatt tttatatctg cagtgatagt ttaattttaat cgcgaatcag
3181 atccggttgc tgagaaaaga agatcgagta cagtatataa ttatcgatta cttgcagttg
3241 atcaactcat cggttggaga aatcgtcaa aatgaaatag cagatatatc tagaacctta
```

FIG. 30A (cont.)

```
3301 agaggtttag cctcagagct aaacattcct atagtttgct tatccaact atctagaaaa
3361 gttgaggata gagcaaataa agttcccatg ctttcagatt tgcgagacag cggtcaaata
3421 gagcaagacg cagatgtgat tttgttatc aatcgtcttc aatcgtcttc taattgtgag
3481 ataactgttg ggaaaaatag acatggaagg gttttctctt cggtattaca tttcgatcca
3541 aaaattagta aattctccgc tattaaaaaa gtatgtaaa ttatagtaac tgccacttca
3601 tcaaaagtcc tatccacctt gaaaatcaga agtttggaag aagacctggt caatctatta
3661 agatatctcc caaattggct caaaatggga agttagaagt tataggtctt gatttcttt
3721 catctcatta ccatgcatta gcagctatcc tggtagaagt tataggtctt gatttcttt
3781 ggaacacaaa aggggttgtt ttatccagag aatcaaatag ttttcaattt gaaggatgga
3841 taccagaat ccgttttaca aaactgaat tcttagaggc ttatggagtt aagcggtata
3901 aaacatccag aaataagtat gagtttagtg gaaaagaagc tgaaactgct ttagaagcct
3961 tataccattt aggacatcaa ccgtttttaa tagtggcaac tgaaactcga tggactaatg
4021 gaacacaaat agtagaccgt taccaaactc tttctccgat cattagaatt tacgaaggat
4081 gggaaggttt aactgacgaa gaaaatatag atatagactt aacacctttt aattcaccat
4141 ctacacggaa acataaaggg ttcgttgtag agccatgtcc tatcttggta gatcaaatag
4201 aatcctactt tgtaatcaag cctgcaaatg tataccaaga aataaaaatg cgcttcccaa
4261 atgcatcaaa gtatgcttac acatttatcg actgggtgat tacagcagct gcgaaaaaga
4321 gacgaaaatt aactaaggat aattcttggc cagaaaaactt gttcttaaac gttaacgtta
4381 aaagtcttgc atatattta aggatgaatc ggtacatttg tacaaggaac ttatctagaa
4441 tcgagttagc tatcgataaa tgtatagaaa tcgccattca gcttggttgg ctatatctaa
4501 gaaaacgcat tgaatttctg gattcttcta aaagaaaatt acaaatgaac caattagaac
4561 ataaaagacg tttgaagaa ataaccaaga aatctaaaga acaaatgaa taattatttt
4621 aagaatctat taattaatag caaacttgaa actaaaaacc taatttattt aaagctcaaa
4681 ataaaaaaga gtttaaaaat gggaaattct ggttttatt tgtataacac tcaaaactgc
4741 gtctttgctg ataatatcaa agttgggcaa atgacagagc cgctcaagga ccagcaaata
4801 atccttggga caacatcaac acctgtcgca gccaaaatga cagcttctga tggaatatct
4861 ttaacagtct ccaataatcc atcaaccaat gcttctatta caattggttt ggatgcggaa
4921 aaagcttacc agcttattct agaaaagttg ggagatcaaa ttccttgtgg aattgctgat
```

FIG. 30A (cont.)

```
4981 actattgttg atagtacagt ccaagatatt ttagacaaaa tcacaacaga cccttctcta
5041 ggtttgttga aagcttttaa caactttcca atcactaata aaattcaatg caacgggtta
5101 ttcactccca ggaacattga aacttttatta ggaggaactg aaataggaaa attcacagtc
5161 acacccaaaa gctctgggag catgttctta gtctcagcag atattattgc atcaagaatg
5221 gaaggcggcg ttgttctagc tttggtacga gaaggtgatt ctaagccta cgcgattagt
5281 tatggatact catcaggcgt tcctaattta tgtagtctaa gaaccagaat tattaataca
5341 ggattgactc cgacaacgta ttcattacgt gtaggcgtt tagaaagcgg tgtggtatgg
5401 gttaatgccc tttctaatgg caatgatatt ttaggaataa caatacttc taatgtatct
5461 ttttggagg taatacctca aacaaacgct ttattggatt ttcttatag
5521 gttttatatt tagagaaaaa agttcgaatt ttatgcaaaa acggggtttg taaaagcaaa
5581 gtgagggacg atttattaaa aattgttaaa gatgtgaaaa aagattccc cgaattagac
5641 ctaaaaatac gagtaaacaa ggaaaaagta acttctttaa attctcctt agaactctac
5701 cataaaagtg tctcactaat tctaggactg cttcaacaa tagaaaactc tttaggatta
5761 ttcccagact ctcctgttct tgaaaaatta gaggataaca gttttaagct aaaaaaggct
5821 ttgattatgc ttatcttgtc tagaaaagac atgtttttcca aggctgaata gataacttac
5881 tctaacgttg gagttgattt gcacacctta gttttttgct cttttaaggg aggaactgga
5941 aaaacaacac tttctctaaa cgtgggatgc aacttggccc aatttttagg gaaaaaagtg
6001 ttacttgctg acctagaccc gcaatccaat ttatcttctg gattggggc tagtgtcaga
6061 agtaaccaaa aaggcttaca cgacatagta tacacatcaa acgattaaa atcaatcatt
6121 tgcgaaacaa aaaaagatag tgtggaccta attcctgcat cattttatc cgaacagttt
6181 agagaattgg atattcatag aggacctagt aacaacttaa agttcctagg gaatgagtac
6241 tgcgctcctt tttatgacat ctgcataata gacactccac ctagcctagg agggttaacg
6301 aaagaagctt ttgttgcagg agacaaatta attgcttgtt taactccaga accttttttct
6361 attctagggt tacaaaagat acgtgaattc ttaagttcgg tcggaaaacc tgaagaagaa
6421 cacattcctg gaatagcttt gtcttttgg actcgactaa ccaatgtat
6481 atagacatta tcgagtctat ttacaaaaac aagcttttt caacaaaaat tcgtcgagat
6541 atttctctca gccgttctct tcttaaagaa gattctgtag ctaatgtcta tccaaattct
```

FIG. 30A (cont.)

```
6601 agggccgcag aagatattct gaagttaacg catgaaatag caaatatttt gcatatcgaa
6661 tatgaacgag attactctca gaggacaacg tgaacaaact aaaaaaagaa gcgaatgtct
6721 tttttaaaaa aaatcaaact gccgcttctt tagatttaa gaagacgctt ccttccattg
6781 aactattctc agcaactttg aattctgagg aaagtcagag tttggatcaa ttatttttat
6841 cagagtccca aaactattcg gatgaagaat tttatcaaga agacatccta gcggtaaaac
6901 tgcttactgg tcagataaaa tccatacaga agcaacacgt acttctttta ggagaaaaaa
6961 tctataatgc tagaaaaatc ctgagtaagg atcacttctc ctcaacaact ttttcatctt
7021 ggatagagtt agtttttaga actaagtctt ctgcttgca tgctcttgca tattacgagc
7081 tttttataaa cctcccaac caaactctac aaaaagagtt tcaatcgatc ccctataaat
7141 ccgcatatat tttggccgct agaaaaggcg atttaaaaac caggtcgat gtgataggga
7201 aagtatgtgg aatgtcgaac tcatcggcga taagggtgtt ggatcaattt ctcccttcat
7261 ctagaaacaa agacgttaga gaaacgatag ataagtctga ttcagagaag aatcgccaat
7321 tatctgattt cttaatagag atactcgca tcatgtgttc cggagtttct ttgtcctcct
7381 ataacgaaaa tcttctacaa cagcttttg aacttttaa gcaaaagagc tgatcctccg
7441 tcagctcata tatatcta ttatatat atattaggg atttgatttt acgagagaga
```

FIG. 30B

Corresponding Amino Acid Sequence of Pgp1 (SEQ ID NO: 234):

MKTRSEIENRMQDIEYALLGKALIFEDSTEYILRQLANYEFKCSHHKNIFIVFKYLKDNGLPITVDSAWEELLRRRIKD
MDKSYLGIMLHDALSNDKLRSVSHTVFLDDLSVCSAEENLSNFIFRSFNEYNENPLRRSPFLLERIKGRLDSAIAKTF
SIRSARGRSIYDIFSQSEIGVLARIKKRRATFSENQNSFFDAFPTGYKDIDDKGVIIAARPSIGKTALAID
MAINLAVTQQRRVGFLSLEMSAGQIVERIIANLTGISGEKLQRGDLSKEELFRVEEAGETVRESHFYICSDSQYKLNLI
ANQIRLLREDRVDVIFIDYLQLINSSVGENRQNEIADISRLRGLASELNIPIVCLSQLSRKVEDRANKVPMLSDLRD
SGQIEQDADVILFINRKESSSNCEITVGKNRHGSVFSSVLHFDPKISKFSAIKKVW

FIG. 30C

Corresponding Amino Acid Sequence of Pgp2 (SEQ ID NO: 235):

MVNYSNCHFIKSPIHLENQKFGRRPGQSIKISPKLAQNGMVEVIGLDFLSSHYHALAAIQRLLTATNYKGNTKGVVLSR
ESNSFQFEGWIPRIRFTKTEFLEAYGVKRYKTSRNKYEFSGKEAETALEALYHLGHQPFLIVATRTRWTNGTQIVDRYQ
TLSPIIRIYEGWEGLTDEENIDIDLTPFNSPSTRKHKGFVVEPCPILVDQIESYFVIKPANVYQEIKMRFPNASKYAYT
FIDWVITAAAKKRRKLTKDNSWPENLFLNVNVKSLAYILRMNRYICTRNWKKIELAIDKCIEIAIQLGWLSRRKRIEFL
DSSKLSKKEILYLNKERFEEITKKSKEQMEQLEQESIN

FIG. 30D

Corresponding Amino Acid Sequence of Pgp3 (SEQ ID NO: 236):

MGNSGFYLYNTQNCVFADNIKVGQMTEPLKDQQIILGTTSTPVAAKMTASDGISLTVSNNPSTNASITIGLDAEKAYQL
IEKLGDQILGGIADTIVDSTVQDILDKITTDPSLGLLKAFNNFPITNKIQCNGLFTPRNIETLLGGTEIGKFTVTPKS
SGSMFLVSADIIASRMEGGVVLALVREGDSKPYAISYGYSSGVPNLCSLRTRIINTGLTPTTYSLRVGGLESGVWVNA
LSNGNDILGITNTSNVSFLEVIPQTNA

FIG. 30E

Corresponding Amino Acid Sequence of Pgp4 (SEQ ID NO: 237):

MQNKSKVRDDFIKIVKDVKKDFPELDLKIRVNKEKVTFLNSPLELYHKSVSLIIGLLQQIENSLGLFPDSPVLEKLEDN
SLKLKKALIMLILSRKDMFSKAE

FIG. 30F

Corresponding Amino Acid Sequence of Pgp5 (SEQ ID NO: 238):

MGCNLAQFLGKKVLLADLDPQSNLSSGLGASVRSNQKGLHDIVYTSNDLKSIICETKKDSVDLIPASFLSEQFRELDIH
RGPSNNLKLFLNEYCAPFYDICIIDTPPSLGGLTKEAFVAGDKLIACLTPEPFSILGLQKIREFLSSVGKPEEHILGI
ALSFWDDRNSTNQMYIDIIESIYKNKLFSTKIRRDISLSRSLLKEDSVANVYPNSRAAEDILKLTHEIANILHIEYERD
YSQRTT

FIG. 30G

Corresponding Amino Acid Sequence of Pgp6 (SEQ ID NO: 239):

MNKLKKEANVFFKKNQTAASLDFKKTLPSIELFSATLNSEESQSLDQLFLSESQNYSDEEFYQEDILAVKLLTGQIKSI
QKQHVLLLGEKIYNARKILSKDHFSSTFSSWIELVFRTKSSAYNALAYYELFINLPNQTLQKEFQSIPYKSAYILAAR
KGDLKTKVDVIGKVCGMSNSSAIRVLDQFLPSSRNKDVRETIDKSDSEKNRQLSDFLIEILRIMCSGVSLSSYNENLLQ
QLFELFKQKS

FIG. 30H

Corresponding Amino Acid Sequence of Pgp7 (SEQ ID NO: 240):

MGSMAFHKSRLFLTFGDASEIWLSTLSHLTRKNYASGINFLVSLEILDLSETLIKAISLDHSESLFKIKSLDVFNGKVV
SEASKQARAACYISFTKFLYRLTKGYIKPAIPLKDFGNTTFFKIRDKIKTESISKQEWTVFFEALRIVNYRDYLIGKLI
VQGIRKLDEILSLRTDDLFFASNQISFRIKKRQNKETKILITFPISLMEELQKYTCGRNGRVFVSKIGIPVTTSQVAHN
FRLAEFYSAMKIKITPRVLRASALIHLKQIGLKDEEIMRISCLSSRQSVCSYCSGEEVSPLVQTPPIL

FIG. 30I

Corresponding Amino Acid Sequence of Pgp8 (SEQ ID NO: 241):

MGKGILSLQQEMSLEYSEKSYQEVLKIRQESYWKRMKSFSLFEVIMHWTASLNKHTCRSYRGSFLSLEKIGLLSLDMNL
QEFSLLNHNLILDAIKKVSSAKTSWTEGTKQVRAASYISLTRFLNRMTQGIVAIAQPSKQENSRTFFKTREIVKTDAMN
SLQTASFLKELKKINARDWLIAQTMLQGGKRSSEVLSLEISQICFQQATISFSQLKNRQTEKRIITYPQKFMHFLQEY
IGQRRGFVFVTRSGKMVGLRQIARTFSQAGLQAAIPFKITPHVLRATAVTEYKRLGCSDSDIMKVTGHATAKMIFAYDK
SSREDNASKKMALI

U.S. 10,258,682 B2

ATTENUATED CHLAMYDIA VACCINE

RELATED APPLICATIONS

This application is a national stage application filed under 35 U.S.C. § 371 of International Application PCT/US2014/011799 (published Jul. 24, 2014 as WO 2014/113541) having an International filing date of Jan. 16, 2014 and which claims priority to U.S. Provisional Application No. 61/753,320, filed Jan. 16, 2013, the entire contents each of which are incorporated in their entireties.

STATEMENT OF RIGHTS TO INVENTIONS MADE UNDER FEDERALLY SPONSORED RESEARCH

Research supporting this application was carried out by the Intramural Research Program of the National Institute of Allergy and Infectious Diseases, National Institutes of Health. The Government has certain rights in this invention.

SEQUENCE LISTING

The instant application contains a Sequence Listing which has been submitted electronically in ASCII format and is hereby incorporated by reference in its entirety. Said ASCII copy is named 90341WO(47992)_SL.txt and is 843,776 bytes in size.

BACKGROUND OF THE INVENTION

*Chlamydia trachomatis* is an obligate intracellular human pathogen with a unique biphasic developmental growth cycle. It's the etiological agent of trachoma, the world's leading cause of preventable blindness and the most common cause of bacterial sexually transmitted disease. *C. trachomatis* isolates maintain a highly conserved plasmid of approximately 7.5 kb with copy numbers ranging from 4 to 10 copies per cell. Naturally occurring plasmidless clinical isolates are rare, implicating its importance in chlamydial pathogenesis. Understanding the plasmid's role in chlamydial pathogenesis at a molecular level is an important objective for the future control of chlamydial infections.

Plasmid-deficient *C. trachomatis* strains and the murine pathogen *C. muridarum* have been studied in both non-human primate and murine infection models. A common theme of these investigations is that in vivo infection with plasmid-deficient organisms are either asymptomatic or exhibit significantly reduced pathology; providing evidence that the plasmid plays an essential role in chlamydial pathogenesis. The molecular basis of plasmid-mediated virulence is poorly understood but is linked to enhanced pro-inflammatory cytokine stimulation by engagement of Toll-like receptors (TLR) in murine models. Notably, in a macaque model of trachoma, ocular infection with plasmid-deficient organisms generates no clinical pathology but induces strong protective immunity against challenge with fully virulent plasmid bearing organisms; findings that support the use of plasmid-deficient organisms as novel live-attenuated chlamydial vaccines.

The chlamydial plasmid encodes both noncoding RNAs and eight ORFs of unknown function. All eight ORFs, designated pgp1-8, have been shown to be expressed in infected cells. Pgp1 was tentatively identified as a helicase based on homology with *E. coli* DnaB. Pgp3 is secreted into the host cell cytosol and has been implicated as a potential TLR4 agonist. Moreover, the plasmid functions as a transcriptional regulator of uncharacterized chromosomal genes that are virulence factors important to chlamydial pathogenicity.

The understanding of chlamydial pathogenesis at the molecular level has been hindered in the past by the lack of genetic tools. Very recently, chlamydial forward and reverse genetics systems, and chlamydial transformation, have been described. However, there have been no reports using these tools to characterize chlamydial genes of unknown function. Accordingly, there is a need to identify the molecular basis of chlamydial pathogenesis in order to develop novel methods and agents for preventing and treating *chlamydia* infection.

SUMMARY OF THE INVENTION

As described below, the present invention features novel vectors suitable for use in delivering immunogens to a subject. The vectors are virulence attenuated and can be used as a vaccine to confer protection against infectious pathogens (e.g., mucosal pathogens such as *Chlamydia*). The vectors can also be used in combination with attenuated pathogenic agents. The introduction of the vector into the attenuated pathogenic agent can improve the stability and replicative capacity of the attenuated pathogen. The invention also features novel plasmid cured *chlamydia* strains. The invention further features compositions containing the vectors, transformed pathogen, and/or cured *chlamydia* strains, as well as methods for using the vectors, transformed pathogen, and/or cured *chlamydia* strains to treat and/or prevent infection by a pathogenic agent (e.g., *chlamydia* infection).

In aspects, the invention provides isolated nucleic acids comprising a *chlamydia* plasmid lacking the pgp4 gene. The pgp4 deletion can be a partial deletion (e.g., 10%, 20%, 30%, 40%, 50%, 60%, 70%, 80%, 90%, 95%, 96%, 97%, 98%, 99%, or any percentage therebetween that results in production of a nonfunctional Pgp4) or a complete deletion of the pgp4 gene.

In embodiments, the isolated nucleic acid comprising pgp1, pgp2, pgp3, pgp5, pgp6, pgp7, or pgp8, wherein the nucleic acid lacks pgp4. In related embodiments, the nucleic acid comprises pgp1, pgp2, pgp6, and pgp8. In some embodiments, the nucleic acid comprises pgp1, pgp2, pgp3, pgp5, pgp6, pgp7, and pgp8.

In embodiments, the nucleic acid is (or is part of) an expression vector.

The nucleic and amino acid sequences of pgp1-8 genes are well known in the art. For example, the pgp1 gene can encode a polypeptide having at least 80%, 85%, 90%, 95%, or 99% to SEQ ID NO: 1, 10, 19, 28, 37, 46, 55, 64, 73, 82, 91, 100, 109, 118, 127, 135, 144, 153, 162, 171, 180, 189, 198, 207, 216, 225, or 234 (i.e., any of the Pgp1 sequences disclosed herein). In embodiments, the pgp2 gene encodes a polypeptide having at least 80%, 85%, 90%, 95%, or 99% to SEQ ID NO: 2, 11, 20, 29, 38, 47, 56, 65, 74, 83, 92, 101, 110, 119, 128, 136, 145, 154, 163, 172, 181, 190, 199, 208, 217, 226, or 235 (i.e., any of the Pgp2 sequences disclosed herein). In embodiments, the pgp3 gene encodes a polypeptide having at least 80%, 85%, 90%, 95%, or 99% to SEQ ID NO: 3, 12, 21, 30, 39, 48, 57, 66, 75, 84, 93, 102, 111, 120, 129, 137, 146, 155, 164, 173, 182, 191, 200, 209, 218, 227, or 236 (i.e., any of the Pgp3 sequences disclosed herein). In embodiments, the pgp4 gene encodes a polypeptide having at least 80%, 85%, 90%, 95%, or 99% to SEQ ID NO: 4, 13, 22, 31, 40, 49, 58, 67, 76, 85, 94, 103, 112, 121, 130, 138, 147, 156, 165, 174, 183, 192, 201, 210, 219, 228, or 237 (i.e., any of the Pgp4 sequences disclosed herein). In embodiments, the pgp5 gene encodes a polypeptide having at least 80%, 85%, 90%, 95%, or 99% to SEQ ID NO: 5, 14, 23, 32, 41, 50, 59, 68, 77, 86, 95, 104, 113, 122, 131, 139, 148, 157, 166, 175, 184, 193, 202, 211, 220, 229, or 238 (i.e., any of the Pgp5 sequences disclosed herein). In embodiments, the pgp6 gene encodes a polypeptide having at least 80%, 85%, 90%, 95%, or 99% to SEQ ID NO: 6, 15, 24, 33, 42, 51, 60, 69, 78, 87, 96, 105, 114, 123, 132, 140, 149, 158, 167, 176, 185, 194, 203, 212, 221, 230, or 239 (i.e., any of the Pgp6 sequences disclosed herein). In embodiments, the pgp7 gene encodes a polypeptide having at least 80%, 85%, 90%, 95%, or 99% to SEQ ID NO: 7, 16, 25, 34, 43, 52, 61, 70, 79, 88, 97, 106, 115, 124, 141, 150, 159, 168, 177, 186, 195, 204, 213, 222, 231, or 240 (i.e., any of the Pgp7 sequences disclosed herein). In embodiments, the pgp8 gene encodes a polypeptide having at least 80%, 85%, 90%, 95%, or 99% to SEQ ID NO: 8, 17, 26, 35, 44, 53, 62, 71, 80, 89, 98, 107, 116, 125, 133, 142, 151, 160, 169, 178, 187, 196, 205, 214, 223, 232, or 241 (i.e., any of the Pgp8 sequences disclosed herein).

In embodiments, the nucleic acid (e.g., the pgp1, pgp2, pgp3, pgp4, pgp5, pgp6, pgp7, and/or pgp8) is derived from J03321, NC_010286, NC_010285, NC_012625, NC_012626, NC_012627, NC_012630, NC_012631, HE603210, HE603212, HE603213, HE603218, HE603227, HE603228, HE603230, HE603232, HE603234, HE603235, HE603236, HE603238, HE603209, CP000052, CP002402, NC_012629, CP002053, and NC_010029.

In aspects of the invention, the nucleic acid further encodes an antigen from an infectious pathogen. In embodiments, the infectious pathogen is a mucosal pathogen. In embodiments, the infectious pathogen is *chlamydia*, human immunodeficiency virus, herpes simplex virus, *Neisseria gonorrhoeae*, *Treponema pallidum*, *Ureaplasma urealyticum*, *Haemophilus vaginalis*, or *Mycoplasma genitalium*.

In some embodiments, the infectious pathogen is *chlamydia*. In related embodiments, the *chlamydia* is a *Chlamydia trachomatis* (*C. trachomatis*) A, B, Ba, C, D, E, F, G, H, I, J, K, L1, L2, L3 serovariant. In some related embodiments, the *chlamydia* is a *C. trachomatis* D, E, F, G, H, I, J, and K serovariant.

In some embodiments, the antigen is a major outer membrane protein (MOMP) or fragments thereof, a polymorphic membrane proteins (PMP) or fragments thereof, or a High Temperature Requirement protein A (HtrA) or fragments thereof.

In embodiments, the nucleic acid further encodes an adjuvant. Adjuvants suitable for use in the invention are well-known in the art. Nonlimiting examples include cytokines or interferons.

In aspects, the invention provides an attenuated pathogen comprising any of the nucleic acids disclosed herein. In embodiments, the pathogen is *chlamydia*. In related embodiments, the *chlamydia* is a *Chlamydia trachomatis* (*C. trachomatis*) A, B, Ba, C, D, E, F, G, H, I, J, K, L1, L2, L3 serovariant. In some related embodiments, the *chlamydia* is a *C. trachomatis* D, E, F, G, H, I, J, and K serovariant. In embodiments, the *chlamydia* is a plasmid deficient *chlamydia* strain.

In embodiments, the *chlamydia* comprises a mutation that reduces the virulence of the *chlamydia* strain. In some embodiments, the mutation is a mutation in the CT135 gene (e.g., a mutation that results in a nonfunctional CT135 protein, e.g., a frameshift mutation at nucleotide 152686). In some embodiments, the mutation is a mutation in the trp operon. In related embodiments, the mutation results in a nonfunctional tryptophan (trp) synthase (e.g., a mutation in the promoter region of the trp operon, a mutation in the trpA gene, and/or a mutation in the trpB gene). For example, the mutation can be a deletion at nucleotides 408-410 in the trpA gene, a single-base deletion at nucleotide 528 in the trpA gene (e.g., ocular serovars), a missense mutation at nucleotide 530 and/or nucleotide 532 in the trpA gene, a mutation that results in TrpA amino acid polymorphisms CQ, YQ, and YE, a deletion at nucleotide 531 in the trpA gene, a deletion at nucleotide 470 in the trpA gene, a two base pair addition at nucleotide 118 in the trpA gene, a 22 base pair deletion at nucleotides 11-21 in the trpB gene, a complete trpA deletion, or a complete trpB deletion.

In aspects, the invention provides a plasmid cured *chlamydia* comprising a mutation that reduces the virulence of the *chlamydia* strain. In embodiments, the *chlamydia* is a *Chlamydia trachomatis* (*C. trachomatis*) A, B, Ba, C, D, E, F, G, H, I, J, K, L1, L2, L3 serovariant. In some embodiments, the *chlamydia* is a *C. trachomatis* D, E, F, G, H, I, J, and K serovariant.

In embodiments, the mutation further reduces the virulence of the *chlamydia* strain as compared to the plasmid cured *chlamydia* strain without the mutation. In some embodiments, the mutation is a mutation in the CT135 gene (e.g., a mutation that results in a nonfunctional CT135 protein, e.g., a frameshift mutation at nucleotide 152686). In some embodiments, the mutation is a mutation in the trp operon. In related embodiments, the mutation results in a nonfunctional tryptophan (trp) synthase (e.g., a mutation in the promoter region of the trp operon, a mutation in the trpA gene, and/or a mutation in the trpB gene). For example, the mutation can be a deletion at nucleotides 408-410 in the trpA gene, a single-base deletion at nucleotide 528 in the trpA gene (e.g., ocular serovars), a missense mutation at nucleotide 530 and/or nucleotide 532 in the trpA ge, a mutation that results in TrpA amino acid polymorphisms CQ, YQ, and YE, a deletion at nucleotide 531 in the trpA gene, a deletion at nucleotide 470 in the trpA gene, a two base pair addition at nucleotide 118 in the trpA gene, a 22 base pair deletion at nucleotides 11-21 in the trpB gene, a complete trpA deletion, or a complete trpB deletion.

In aspects, the invention provides compositions comprising any of the nucleic acids, attenuated pathogens, or plasmid cured chlamydias with a further attenuating mutation described herein. In embodiments, the composition further comprises a pharmaceutically acceptable excipient, carrier, or diluent.

In embodiments, the composition is an immunogenic composition. In related embodiments, the immunogenic composition is capable of eliciting or modulating an immune response. In some embodiments, the immune response is a cell mediated response. In some embodiments, the immune response is a humoral response (e.g., a mucosal antibody response). In some embodiments, the immunogenic composition is a vaccine.

In aspects, the invention provides methods for inducing an immune response in a subject. In embodiments, the methods involve administering to the subject an effective amount of any of the nucleic acids, attenuated pathogens, plasmid cured chlamydias with a further attenuating mutation, or compositions described herein.

In aspects, the invention provides methods for modulating an immune response in a subject. In embodiments, the methods involve administering to the subject an effective amount of any of the nucleic acids, attenuated pathogens, plasmid cured chlamydias with a further attenuating mutation, or compositions described herein.

In embodiments, the above methods prevent or treat an infection (e.g., a viral infection, a bacterial infection, a fungal infection, or a parasitic infection). In some embodiments, the infection is an infection by a mucosal pathogen. In related embodiments, the infection is an infection by *chlamydia*, human immunodeficiency virus, herpes simplex virus, *Neisseria gonorrhoeae, Treponema pallidum, Ureaplasma urealyticum, Haemophilus vaginalis*, or *Mycoplasma genitalium*.

In some embodiments, the infection is a *chlamydia* infection. In related embodiments, the *chlamydia* is a *Chlamydia trachomatis* (*C. trachomatis*) A, B, Ba, C, D, E, F, G, H, I, J, K, L1, L2, L3 serovariant. In some related embodiments, the *chlamydia* is a *C. trachomatis* D, E, F, G, H, I, J, and K serovariant.

In aspects, the invention provides methods for treating or preventing an infection in a subject. In embodiments, the methods involve administering to the subject an effective amount of any of the nucleic acids, attenuated pathogens, plasmid cured chlamydias with a further attenuating mutation, or compositions described herein. In embodiments, the methods involve generating an immune response in the subject, wherein the immune response prevents or treats the infection. In embodiments, the immune response is a cell mediated response, a humoral response, and/or a mucosal antibody response.

In aspects, the invention provides methods for immunizing a subject against infection by a pathogen. In embodiments, the methods involve administering to the subject an effective amount of any of the nucleic acids, attenuated pathogens, plasmid cured chlamydias with a further attenuating mutation, or compositions described herein.

In embodiments, the infection is a viral infection, a bacterial infection, a fungal infection, or a parasitic infection. In some embodiments, the infection is an infection by a mucosal pathogen. In some related embodiments, the infection is an infection by *chlamydia*, human immunodeficiency virus, herpes simplex virus, *Neisseria gonorrhoeae, Treponema pallidum, Ureaplasma urealyticum, Haemophilus vaginalis*, or *Mycoplasma genitalium*.

In embodiments, the infection is a *chlamydia* infection. In related embodiments, the *chlamydia* is a *Chlamydia trachomatis* (*C. trachomatis*) A, B, Ba, C, D, E, F, G, H, I, J, K, L1, L2, L3 serovariant. In some related embodiments, the *chlamydia* is a *C. trachomatis* D, E, F, G, H, I, J, and K serovariant.

In any of the above aspects and embodiments, the subject can be a mammal (e.g., human).

In any of the above aspects and embodiments, the nucleic acids, attenuated pathogens, plasmid cured chlamydias with a further attenuating mutation, or compositions are administered systemically or locally. In embodiments, the nucleic acids, attenuated pathogens, plasmid cured chlamydias with a further attenuating mutation, or compositions are administered by intramuscular injection, intradermal injection, intravenous injection, subcutaneous injection, or topical administration.

In any of the above aspects and embodiments, the nucleic acids, attenuated pathogens, plasmid cured chlamydias with a further attenuating mutation, or compositions are administered in a prime boost regimen.

In aspects, the invention provides kits containing the nucleic acids, attenuated pathogens, plasmid cured chlamydias with a further attenuating mutation, or compositions described herein.

In aspects, the invention provides kits for the treatment or prevention of infection by a pathogen. In embodiments, the kits contain the nucleic acids, attenuated pathogens, plasmid cured chlamydias with a further attenuating mutation, or compositions described herein. In embodiments, the kit further contains instructions for using the kit in at least one of the methods described herein. In embodiments, the pathogen is *chlamydia*, human immunodeficiency virus, herpes simplex virus, *Neisseria gonorrhoeae, Treponema pallidum, Ureaplasma urealyticum, Haemophilus vaginalis*, or *Mycoplasma genitalium*. In some embodiments, the pathogen is *chlamydia*. In related embodiments, the *chlamydia* is a *Chlamydia trachomatis* (*C. trachomatis*) A, B, Ba, C, D, E, F, G, H, I, J, K, L1, L2, L3 serovariant. In some related embodiments, the *chlamydia* is a *C. trachomatis* D, E, F, G, H, I, J, and K serovariant.

In aspects, the invention provides host cells containing at least one of the nucleic acids described herein. The cell can be in vitro, in vivo, or ex vivo. In embodiments, wherein the host cell is a bacterial, mammalian, insect, or yeast cell.

Additional objects and advantages of the invention will be set forth in part in the description which follows, and in part will be obvious from the description, or may be learned by practice of the invention. The objects and advantages of the invention will be realized and attained by means of the elements and combinations disclosed herein, including those pointed out in the appended claims. It is to be understood that both the foregoing general description and the following detailed description are exemplary and explanatory only and are not restrictive of the invention as claimed. The accompanying drawings, which are incorporated herein and constitute a part of this specification, illustrate several embodiments of the invention and, together with the description, serve to explain the principles of the invention.

DEFINITIONS

To facilitate an understanding of the present invention, a number of terms and phrases are defined below.

As used herein, the singular forms "a", "an", and "the" include plural forms unless the context clearly dictates otherwise. Thus, for example, reference to "an antigen" includes reference to more than one antigen.

Unless specifically stated or obvious from context, as used herein, the term "or" is understood to be inclusive.

As used herein, the terms "comprises," "comprising," "containing," "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

As used herein, "adjuvant" is understood as a pharmacological or immunological agent that modifies the effect of other agents (e.g., immunogenic composition) while having few if any direct effects when given by itself. Adjuvants are frequently administered with vaccines to enhance the recipient's immune response to a supplied antigen while keeping the injected foreign material at a minimum. Adjuvants may be essentially inert when administered alone.

"Administering" is defined herein as a means of providing an agent or a composition containing the agent to a subject in a manner that results in the agent being inside the subject's body. Such an administration can be by any route including, without limitation, oral, transdermal (e.g., vagina, rectum, oral mucosa), by injection (e.g., subcutaneous, intravenous, parenterally, intraperitoneally, intrathecal), or by inhalation (e.g., oral or nasal). Pharmaceutical preparations are, of course, given by forms suitable for each administration route.

By "agent" is meant any small molecule chemical compound, antibody, nucleic acid molecule, or polypeptide, or fragments thereof.

By "ameliorate" is meant decrease, suppress, attenuate, diminish, arrest, or stabilize the development or progression of a disease or a symptom thereof.

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

As used herein, "attenuated" is understood as an agent/strain (or a composition containing the agent/strain) created by reducing the virulence of a pathogen, but still keeping it viable (or "live"). Attenuation takes a living agent and alters it so that it becomes harmless or less virulent. These vaccines contrast to those produced by "killing/inactivating" the pathogen. As used herein, an attenuated bacteria can be propagated in at least one cell type, either in a host organism or in culture.

As used herein, "changed as compared to a control" sample or subject is understood as having a level of the analytic or diagnostic or therapeutic indicator to be detected at a level that is statistically different than a sample from a normal, untreated, or control sample. Control samples include, for example, cells in culture, one or more laboratory test animals, or one or more human subjects. Methods to select and test control samples are within the ability of those in the art. An analytic substance can be a naturally occurring substance that is characteristically expressed or produced by the cell or organism (e.g., antibodies, viral particles, and the like) or a substance produced by a reporter construct (e.g, β-galactosidase, luciferase, and the like). Depending on the method used for detection the amount and measurement of the change can vary. Determination of statistical significance is within the ability of those skilled in the art.

As used herein, "*chlamydia* bacterium serovariant" and "*chlamydia*" refer to a genus of bacteria, including serovariants of *Chlamydia trachomatis* such as A, B, Ba, C, D, E, F, G, H, I, J, K, L1, L2, L3. *Chlamydia* infection and chlamydial infection refer to the infection of a subject by a *chlamydia* bacteria. Strains from any of these organisms may be obtained worldwide from any biologicals depository. Examplary strains of *chlamydia* that may be obtained from the ATCC include, but are not limited to, A HAR-13 (VR-571B), B (n/a), Ba (n/a), C TW-3 (VR-1477), D UW-3/Cx (VR-885), E BOUR (VR-348B), F IC-Cal-3 (VR-346), G UW-57/Cx (VR-878), H UW-43/Cx (VR-879), I UW-12/Ur (VR-880), J UW-36/Cx (VR-886), K UW-31/Cx (VR-887), LGV Type 1 (VR-901B), LGV Type 2 (VR-577), LGV Type 3 (VR-903).

As used herein, "*chlamydia* related disorder or condition" refers to *chlamydia* infections and related symptoms and conditions and to sexually transmitted diseases and trachoma.

As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' non-translated regions, and the like, are not part of a coding region. Any vector may contain a single coding region, or may comprise two or more coding regions, e.g., a vector of the present invention may encode one or more polyproteins, which are post- or co-translationally separated into the final proteins via proteolytic cleavage. In addition, a vector of the invention may encode heterologous coding regions. Heterologous coding regions include without limitation specialized elements or motifs, such as a secretory signal peptide or a heterologous functional domain. Heterologous coding regions can also include the coding sequence of a target antigen.

"Co-administration" as used herein is understood as administration of one or more agents to a subject such that the agents are present and active in the subject at the same time. Co-administration does not require a preparation of an admixture of the agents or simultaneous administration of the agents. The order or sequence of administering the different agents may vary and is not confined to any particular sequence. Co-administering may also refer to two or more agents administered via the same or different routes of delivery.

The phrase "combination therapy" embraces the administration of one agent (e.g., a bacterial vector, a *chlamydia* vaccine, an immunogen from a pathogenic agent, and the like) and a second therapeutic agent as part of a specific treatment regimen intended to provide a beneficial effect from the co-action of these therapeutic agents. The beneficial effect of the combination includes, but is not limited to, pharmacokinetic or pharmacodynamic co-action resulting from the combination of therapeutic agents. Administration of these therapeutic agents in combination typically is carried out over a defined time period (usually minutes, hours, days, or weeks depending upon the combination selected). "Combination therapy" generally is not intended to encompass the administration of two or more of these therapeutic agents as part of separate monotherapy regimens that incidentally and arbitrarily result in the combinations of the present invention. "Combination therapy" is intended to embrace administration of these therapeutic agents in a sequential manner, that is, wherein each therapeutic agent is administered at a different time, as well as administration of these therapeutic agents, or at least two of the therapeutic agents, in a substantially simultaneous manner. Sequential or substantially simultaneous administration of each therapeutic agent can be effected by any appropriate route including, but not limited to, oral routes, intravenous routes, intramuscular routes, and direct absorption through mucous membrane tissues (e.g., nasal, mouth, vaginal, and rectal). The therapeutic agents can be administered by the same route or by different routes. For example, one component of a particular combination may be administered by intravenous injection while the other component(s) of the combination may be administered orally. The components may be administered in any therapeutically effective sequence.

The phrase "combination" embraces groups of compounds or non-drug therapies useful as part of a combination therapy.

"Complementary" as used herein in relation to nucleic acids is understood by its usual meaning of two nucleic acid strands (either individual strands or portions of a single strand folded back on itself) in which each A pairs with a T (in DNA) or a U (in RNA); and each C pairs with a G. As used herein, nucleic acid sequences can be complementary over a specific number of contiguous nucleotides (e.g., nucleotides touching or connected throughout in an unbroken sequence).

"Contacting a cell" is understood herein as providing an agent to a cell, e.g., a cell to be treated in culture, ex vivo, or in an animal, such that the agent can interact with the cell (e.g., cell to be treated), potentially be taken up by the cell, and have an effect on the cell. The agent (e.g., an infectious pathogen) can be delivered to the cell directly (e.g., by addition of the agent to culture medium or by injection into the cell or tissue of interest), or by delivery to the organism by a topical or parenteral route of administration for delivery to the cell by vascular, lymphatic, or other means.

By "control" is meant a standard or reference condition.

As used herein, "detecting", "detection", and the like are understood that an assay performed to determine one or more characteristics of a sample, e.g. identifying the presence, absence or amount of the analyte to be detected. For example, detection can include identification of a specific analyte in a sample, a product from a reporter construct, heterologous expression construct (e.g., bacterial vector), or infectious pathogen (e.g., attenuated bacterial vaccine) in a sample, or an activity of an agent in a sample. Detection can include the determination of nucleic acid or protein expression, or dye uptake in a cell or tissue, e.g., as determined by PCR, immunoassay, microscopy, and the like. Detection can include determination of the presence of an antibody using routine immunological methods, e.g., ELISA, pathogen challenge, and the like. The amount of analyte or activity detected in the sample can be none or below the level of detection of the assay or method.

By "disease" is meant any condition or disorder that damages or interferes with the normal function of a cell, tissue, or organ (e.g., damage or interference caused by an infectious pathogen).

The term "disrupt" is meant to refer to compromise the barrier function of the epithelium. In certain examples, physical methods can be used to disrupt an epithelial surface. In other examples, chemical agents can be used to disrupt an epithelial surface, for example ionic or non-ionic detergents.

The terms "effective amount," or "effective dose" refers to that amount of an agent to produce the intended pharmacological, therapeutic, or preventive result. The pharmacologically effective amount that results in the prevention of onset of disease, either in an individual or in the frequency of disease in a population, as a result of contact with a bacteria or pathogen that causes disease. More than one dose may be required to provide an effective dose. It is understood that an effective dose in one population may or may not be sufficient in all populations. Thus, an agent that is "effective against" a disease or condition indicates that administration in a clinically appropriate manner results in a beneficial effect for at least a statistically significant fraction of subjects, such as a prevention of disease onset, improvement of symptoms, a cure, a reduction in disease signs or symptoms, extension of life, improvement in quality of life, or other effect generally recognized as positive by medical doctors familiar with treating the particular type of disease or condition.

By "enhances" or "increases" is meant a positive alteration of at least about 10%, 25%, 50%, 75%, or 100% relative to a reference.

The term "epithelial surface" is meant to refer to a continuous sheet of one or more cellular layers that lines a vertebrate body compartment. An epithelial surface can be the skin. Epithelial surfaces according to certain embodiments of the invention can be cervicovaginal, oral, nasal, penile, anal, epidermal and respiratory surfaces.

By "fragment" is meant a portion of a polypeptide or nucleic acid molecule. This portion contains at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

As used herein, a "host cell" is any cell in which an infectious agent (e.g., *chlamydia*) can be propagated.

"Hybridization" means hydrogen bonding, which may be Watson-Crick, Hoogsteen, or reversed Hoogsteen hydrogen bonding between complementary nucleobases. For example, adenine and thymine are complementary nucleobases that pair through the formation of hydrogen bonds.

The terms "identical" or "percent identity" in the context of two or more nucleic acids or polypeptides, refer to two or more sequences or subsequences that are the same or have a specified percentage of nucleotides or amino acid residues that are the same, when compared and aligned (introducing gaps, if necessary) for maximum correspondence, not considering any conservative amino acid substitutions as part of the sequence identity. The percent identity may be measured using sequence comparison software or algorithms or by visual inspection. Various algorithms and software are known in the art that may be used to obtain alignments of amino acid or nucleotide sequences. One such non-limiting example of a sequence alignment algorithm is the algorithm described in Karlin et al., *Proc. Natl. Acad. Sci.*, 87:2264-2268 (1990), as modified in Karlin et al., *Proc. Natl. Acad. Sci.*, 90:5873-5877 (1993), and incorporated into the NBLAST and XBLAST programs (Altschul et al., *Nucleic Acids Res.*, 25:3389-3402 (1991)). In certain embodiments, Gapped BLAST may be used as described in Altschul et al., *Nucleic Acids Res.* 25:3389-3402 (1997). BLAST-2, WU-BLAST-2 (Altschul et al., *Methods in Enzymology*, 266:460-480 (1996)), ALIGN, ALIGN-2 (Genentech, South San Francisco, Calif.) or Megalign (DNASTAR) are additional publicly available software programs that can be used to align sequences. In certain embodiments, the percent identity between two nucleotide sequences is determined using the GAP program in GCG software (e.g., using a NWSgapdna.CMP matrix and a gap weight of 40, 50, 60, 70, or 90 and a length weight of 1, 2, 3, 4, 5, or 6). In certain embodiments, the GAP program in the GCG software package, which incorporates the algorithm of Needleman and Wunsch (*J. Mol. Biol.* (48):444-453 (1970)) may be used to determine the percent identity between two amino acid sequences (e.g., using either a Blossum 62 matrix or a PAM250 matrix, and a gap weight of 16, 14, 12, 10, 8, 6, or 4 and a length weight of 1, 2, 3, 4, 5). In certain embodiments, the percent identity between nucleotide or amino acid sequences is determined using the algorithm of Myers and Miller (CABIOS, 4:11-17 (1989)). For example, the percent identity may be determined using the ALIGN program (version 2.0) and using a PAM120 with residue table, a gap length penalty of 12 and a gap penalty of 4. Appropriate parameters for maximal alignment by particular alignment software can be determined by one skilled in the art. In certain embodiments, the default parameters of the alignment software are used. In certain embodiments, the percentage identity "X" of a first amino acid sequence to a second sequence amino acid is calculated as 100×(Y/Z), where Y is the number of amino acid residues scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be longer than the percent identity of the second sequence to the first sequence.

As a non-limiting example, whether any particular polynucleotide has a certain percentage sequence identity (e.g., is at least 80% identical, at least 85% identical, at least 90% identical, and in some embodiments, at least 95%, 96%, 97%, 98%, or 99% identical) to a reference sequence can, in certain embodiments, be determined using the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman, *Advances in Applied Mathematics* 2: 482 489 (1981), to find the best segment of homology between two sequences. When using Bestfit or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5% of the total number of nucleotides in the reference sequence are allowed.

In some embodiments, two nucleic acids or polypeptides of the invention are substantially identical, meaning they have at least 70%, at least 75%, at least 80%, at least 85%, at least 90%, and in some embodiments at least 95%, 96%, 97%, 98%, 99% nucleotide or amino acid residue identity, when compared and aligned for maximum correspondence, as measured using a sequence comparison algorithm or by visual inspection. Identity can exist over a region of the sequences that is at least about 5, at least about 10, about 20, about 40-60 residues in length or any integral value therebetween, or over a longer region than 60-80 residues, at least about 90-100 residues, or the sequences are substantially identical over the full length of the sequences being compared.

As used herein, an "immunoassay" is a detection method based on the specific binding of at least one antibody to an antigen, e.g., ELISA, RIA, western blot, and the like.

As used herein "immunogen", "immunogenic", and the like refer to substances that can promote an immune response, e.g., an antibody based or cell mediated immune response, in at least one organism. In embodiments, the immunogen is a polypeptide or polypeptide fragment from an infectious pathogen (e.g., *chlamydia*).

By "immunogenic composition" is meant a composition comprising a molecule capable of inducing or modulating an immune response in a subject. Such an immune response may be a prophylactic or therapeutic immune response. In embodiments, the immunogenic composition is a vaccine.

As used herein "inducing immunity" is meant to refer to any immune response generated against an antigen. In embodiments, immunity is mediated by antibodies against an infectious pathogen, which is exhibited by a vertebrate (e.g., a human), that prevents or ameliorates an infection or reduces at least one symptom thereof. The vectors of the invention can stimulate the production of antibodies that, for example, neutralize infectious agents, block infectious agents from entering cells, block replication of infectious agents, and/or protect host cells from infection and destruction. The term can also refer to an immune response that is mediated by T-lymphocytes and/or other white blood cells against an infectious agent, exhibited by a vertebrate (e.g., a human), that prevents or ameliorates an infection, for example chlamydial infection, or reduces at least one symptom thereof.

As used herein, "infectious construct" indicates a pathogen, a pathogenic construct, a pathogenic chimera, a nucleic acid derived from a pathogen or any portion thereof, which may be used to infect a cell.

"Isolated" when used in reference to a cell means the cell is in culture (e.g., not in an animal), either cell culture or organ culture, of a primary cell or cell line. Cells can be isolated from a normal animal, a transgenic animal, an animal having spontaneously occurring genetic changes, an animal having a genetic and/or induced disease or condition, and the like. An isolated bacteria or bacterial vector is a bacteria that is removed from the cells, typically in culture, in which the bacteria was produced.

By "isolated polynucleotide" or "isolated nucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. In embodiments, the preparation is at least 75%, at least 90%, or at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, HPLC analysis, and the like.

As used herein, a "mutation" is a change in the amino acid or nucleic acid sequence as compared to the wild type sequence. In a nucleic acid coding sequence, the mutation results in a change of the amino acid sequence encoded by the nucleic acid. As used herein, a mutation in a coding sequence preferably does not result in a frame shift in the coding sequence. A mutation can be an insertion, deletion, or change of one or more (e.g., 1, 2, 3, 4, 5, 6, 7, 8, 9, 10, 20, 30, 40, 50 or more, and any number therebetween) amino acids or nucleotides as compared to a wild type sequence.

A "conservative amino acid substitution" is one in which one amino acid residue is replaced with another amino acid residue having a similar side chain Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

For example, substitution of a phenylalanine for a tyrosine is a conservative substitution. Preferably, conservative substitutions in the sequences of the polypeptides and antibodies of the invention do not abrogate the binding of the polypeptide or antibody containing the amino acid sequence, to the antigen(s). Methods of identifying nucleotide and amino acid conservative substitutions which do not eliminate antigen binding are well-known in the art (see, e.g., Brummell et al., *Biochem.* 32: 1180-1187 (1993); Kobayashi et al. *Protein Eng.* 12(10):879-884 (1999); and Burks et al. *Proc. Natl. Acad. Sci. USA* 94:412-417 (1997)).

In aspects of the invention, the chlamydial vectors of the present invention include mutations, for example to attenuate the bacteria. In embodiments, the *chlamydia* vector includes a deletion of pgp4. In related embodiments, the *chlamydia* vector comprises at least one additional deletion of a non-essential ORF (e.g., pgp3, -5, and -7). In embodiments, the chlamydial vector is expressed in an attenuated bacterial strain. Such strains are well known in the art, and include those described in Caldwell, H. D. et al., *J. Clin. Invest.* 11:1757-69 (2003) and Sturdevant, G. et al., *Infect. Immun.* 78:3660-8 (2010), the contents of each of these references are hereby incorporated by reference in their entirety. Attenuating bacterial strains have at least one mutation that reduces the virulence of the bacteria. For example, the mutation can be a mutation in the CT135 gene (e.g., a mutation at nucleotide 152686 that causes an insertion of a T that results in a frame shift). The mutation can also be a mutation in the trp operon (e.g., mutations in the promoter region, the trpA gene, and/or the trpB gene that results in the production of a nonfunctional tryptophan (trp) synthase. Nonlimiting examples of such mutations include a deletion at nucleotides 408-410 in the trpA gene (e.g., ocular serovars), a single-base deletion at nucleotide 528 in the trpA gene (e.g., ocular serovars), a missense mutation at nucleotide 530 and/or nucleotide 532 in the trpA gene (e.g., genital serovars), a mutation(s) that results in TrpA amino acid polymorphisms CQ, YQ, and YE (e.g., genital serovars), a deletion at nucleotide 531 in the trpA gene (e.g., ocular serovars), a deletion at nucleotide 470 in the trpA gene (e.g., ocular serovars), a two base pair addition at nucleotide 118 in the trpA gene (e.g., ocular serovars), a 22 base pair deletion at nucleotides 11-21 in the trpB gene (e.g., ocular serovars), a complete trp (trpA and/or trpB) deleted region (e.g., ocular serovars), or a CT135 polymorphism (i.e., a mutation in the CT135 locus) that reduces the virulence of the *chlamydia* strain.

As used herein, “nucleic acid” as in a nucleic acid for delivery to a cell is understood by its usual meaning in the art as a polynucleotide or oligonucleotide which refers to a string of at least two base-sugar-phosphate combinations. Nucleotides are the monomeric units of nucleic acid polymers. The term includes deoxyribonucleic acid (DNA) and ribonucleic acid (RNA) in the form of an oligonucleotide messenger RNA, anti-sense, plasmid DNA, parts of a plasmid DNA, genetic material derived from an infectious pathogen (e.g., bacteria), and the like. Polynucleotides include nucleic acids of at least two monomers. Anti-sense polynucleotides are nucleic acids that interfere with the function of DNA or RNA. An siRNA or an shRNA is a double stranded RNA that inhibits or disrupts activity or translation, for example by promoting degradation of modifying splicing or processing of the cellular nucleic acid, e.g., mRNA, microRNA, and the like, to which it is targeted. As used herein, siRNA and shRNA include any double stranded RNA molecule that can modulate the stability, translation, or splicing of an RNA to which at least one strand of the double stranded nucleic acid hybridizes. RNAs are well known in the art, see, e.g., patent publications WO02/44321; WO/2003/099298; US 20050277610; US 20050244858; and U.S. Pat. Nos. 7,297,786, 7,560,438 and 7,056,704, all of which are incorporated herein by reference. Nucleic acid as used herein is understood to include non-natural nucleotides (not occurring in nature), for example: a derivative of natural nucleotides such as phosphothionates or peptide nucleic acids (such as those described in the patents and applications cited immediately above). A nucleic acid can be delivered to a cell in order to produce a cellular change that is therapeutic. The delivery of a nucleic acid or other genetic material for therapeutic purposes is gene therapy. The nucleic acid may express a protein or polypeptide, e.g., a protein that is missing or non-functional in the cell or subject. The nucleic acid may be single or double stranded, may be sense or anti-sense, and can be delivered to a cell as naked DNA, in combination with agents to promote nucleic acid uptake into a cell (e.g., transfection reagents), in the context of a bacterial vector, and the like. The nucleic acid can be targeted to a nucleic acid that is endogenous to the cell (mRNA or microRNA), or a heterologous nucleic acid (e.g., nucleic acid from a pathogen, such as a viral gene). Delivery of a nucleic acid means to transfer a nucleic acid from outside a subject to within the outer cell membrane of a cell in the subject.

The term “nucleotide encoding a polypeptide” or “polynucleotide encoding a polypeptide” encompasses a polynucleotide which includes only coding sequences for the polypeptide as well as a polynucleotide which includes additional coding and/or non-coding sequences. The polynucleotides of the invention can be in the form of RNA or in the form of DNA. DNA includes cDNA, genomic DNA, and synthetic DNA; and can be double-stranded or single-stranded, and if single stranded can be the coding strand or non-coding (anti-sense) strand.

“Obtaining” is understood herein as manufacturing, purchasing, synthesizing, isolating, purifying, or otherwise coming into possession of.

As used herein, “operably linked” is understood as joined, preferably by a covalent linkage, e.g., joining an amino-terminus of one peptide to a carboxyl terminus of another peptide, e.g., expressing a signal sequence to target the protein to a specific cellular compartment; joining a promoter sequence with coding or non-coding nucleic acid sequence, in a manner that the two or more components that are operably linked either retain their original activity, or gain an activity upon joining such that the activity of the operably linked portions can be assayed, colocalized, and/or have detectable activity, e.g., transcription or translation inhibition, enzymatic activity, protein expression activity, nucleic acid levels, and the like.

As used herein, “ORF” or “open reading frame” is understood to be a series of nucleotide triplets (codons) coding for amino acids without any termination codons. These sequences are usually translatable into a peptide.

The term “patient” or “subject” refers to an animal which is the object of treatment, observation, or experiment. By way of example only, a subject includes, but is not limited to, a mammal, including, but not limited to, a human or a non-human mammal, such as a non-human primate, bovine, equine, canine, ovine, or feline.

By “Pgp1” and the like is meant a protein or fragment thereof having at least 85%, 90%, 95%, 99%, or more identity to the amino acid sequence corresponding to NCBI Accession No. YP_001654079 (corresponding to protein sequence of GENE ID NO: 5857573) (SEQ ID NO:1):

```
  1 mktrseienr mqdieyallg kalifedste yilrqlanye fkcshhknif ivfkylkdng 61 lpitvdsawe ellrrrikdm dksylglmlh dalsndklrs vshtvflddl svcsaeenls 121 nfifrsfney nenplrrspf lllerikgrl dsaiaktfsi rsargrsiyd ifsqseigvl 181 arikkrratf senqnsffda fptgykdidd kgvilakgnf viiaarpsig ktalaidmai 241 nlavtqqrry gflslemsag qiveriianl tgisgeklqr gdlskeelfr veeagetvre 301 shfyicsdsq yklnlianqi rllrkedrvd vifidylqli nssvgenrqn eiadisrtlr 361 glaselnipi vclsqlsrkv edrankvpml sdlrdsgqie qdadvilfin rkesssncei 421 tvgknrhgsv fssvlhfdpk iskfsaikkv w
```

By "pgp1" and the like is meant a polynucleotide encoding a Pgp1 polypeptide or fragment thereof.

By "Pgp2" and the like is meant a protein or fragment thereof having at least 85%, 90%, 95%, 99%, or more identity to the amino acid sequence corresponding to NCBI Accession No. YP_001654078 (corresponding to protein sequence of GENE ID NO: 5857572) (SEQ ID NO:2):

```
  1 mvnysnchfi kspihlenqk fgrrpgqsik ispklaqngm vevigldfls shyhalaaiq 61 rlltatnykg ntkgvvlsre snsfqfegwi prirftktef leaygvkryk tsrnkyefsg 121 keaetaleal yhlghqpfli vatrtrwtng tqivdryqtl spiiriyegw egltdeenid 181 idltpfnsps trkhkgfvve pcpilvdqie syfvikpanv yqeikmrfpn askyaytfid 241 wvitaaakkr rkltkdnswp enlflnvnvk slayilrmnr yictrnwkki elaidkciei 301 aiqlgwlsrr kriefldssk lskkeilyln kerfeeitkk skeqmeqleq esin
```

By "pgp2" and the like is meant a polynucleotide encoding a Pgp2 polypeptide or fragment thereof.

By "Pgp3" and the like is meant a protein or fragment thereof having at least 85%, 90%, 95%, 99%, or more identity to the amino acid sequence corresponding to NCBI Accession No. YP_001654077 (corresponding to protein sequence of GENE ID NO: 5857580) (SEQ ID NO:3):

```
  1 mgnsgfylyn tqncvfadni kvgqmteplk dqqiilgtts tpvaakmtas dgisltvsnn 61 pstnasitig ldaekayqli leklgdqilg giadtivdst vqdildkitt dpslgllkaf 121 nnfpitnkiq cnglftprni etllggteig kftvtpkssg smflvsadii asrmeggvvl 181 alvregdskp yaisygyssg vpnlcslrtr iintgltptt yslrvggles gvvwvnalsn 241 gndilgitnt snvsflevip qtna
```

By "pgp3" and the like is meant a polynucleotide encoding a Pgp3 polypeptide or fragment thereof.

By "Pgp4" and the like is meant a protein or fragment thereof having at least 85%, 90%, 95%, 99%, or more identity to the amino acid sequence corresponding to NCBI Accession No. YP_001654076 (corresponding to protein sequence of GENE ID NO: 5857575) (SEQ ID NO:4):

```
  1 mqnkskvrdd fikivkdvkk dfpeldlkir vnkekvtfln splelyhksv slilgllqqi 61 enslglfpds pvlekledns lklkkaliml ilsrkdmfsk ae
```

By "pgp4" and the like is meant a polynucleotide encoding a Pgp4 polypeptide or fragment thereof.

By "Pgp5" and the like is meant a protein or fragment thereof having at least 85%, 90%, 95%, 99%, or more identity to the amino acid sequence corresponding to NCBI Accession No. YP_001654083 (corresponding to protein sequence of GENE ID NO: 5857574) (SEQ ID NO:5):

```
  1 gltkeafvag dkliacltpe pfsilglqki reflssvgkp eeehilgial sfwddrnstn 61 qmyidiiesi yknklfstki rrdislsrsl lkedsvanvy pnsraaedil kltheianil 121 hieyerdysq rtt
```

By "pgp5" and the like is meant a polynucleotide encoding a Pgp5 polypeptide or fragment thereof.

By "Pgp6" and the like is meant a protein or fragment thereof having at least 85%, 90%, 95%, 99%, or more identity to the amino acid sequence corresponding to NCBI Accession No. YP_001654082 (corresponding to protein sequence of GENE ID NO: 5857578) (SEQ ID NO:6):

```
  1 mnklkkeanv ffkknqtaas ldfkktlpsi elfsatlnse esqsldqlfl sesqnysdee 61 fyqedilavk lltgqiksiq kqhvlllgek iynarkilsk dhfssttfss wielvfrtks 121 saynalayye lfinlpnqtl qkefqsipyk sayilaarkg dlktkvdvig kvcgmsnssa 181 irvldqflps srnkdvreti dksdseknrq lsdflieilr imcsgvslss ynenllqqlf 241 elfkqks
```

By "pgp6" and the like is meant a polynucleotide encoding a Pgp6 polypeptide or fragment thereof.

By "Pgp7" and the like is meant a protein or fragment thereof having at least 85%, 90%, 95%, 99%, or more identity to the amino acid sequence corresponding to NCBI Accession No. YP_001654081 (corresponding to protein sequence of GENE ID NO: 5857579) (SEQ ID NO:7):

```
  1 mgsmafhksr lfltfgdase iwlstlshlt rknyasginf lvsleildls etlikaisld 61 hseslfkiks ldvfngkvvs easkqaraac yisftkflyr ltkgyikpai plkdfgnttf 121 fkirdkikte siskqewtvf fealrivnyr dyligklivq girkldeils lrtddlffas 181 nqisfrikkr qnketkilit fpislmeelq kytcgrngry fvskigipvt tsqvahnfrl 241 aefysamkkk llleyfvgal
```

By "pgp7" and the like is meant a polynucleotide encoding a Pgp7 polypeptide or fragment thereof.

By "Pgp8" and the like is meant a protein or fragment thereof having at least 85%, 90%, 95%, 99%, or more identity to the amino acid sequence corresponding to NCBI Accession No. YP_001654080 (corresponding to protein sequence of GENE ID NO: 5857576) (SEQ ID NO:8):

```
  1 mgkgilsiqq emsleyseks yqevlkirqe sywkrmksfs lfevimhwta slnkhtcrsy 61 rgsflsleki gllsldmnlq efsllnhnli ldaikkvssa ktswtegtkq vraasyislt 121 rflnrmtqgi vaiaqpskqe nsrtffktre ivktdamnsl qtasflkelk kinardwlia 181 qtmlqggkrs sevlsleisq icfqqatisf sqlknrqtek riiitypqkf mhflqeyigq 241 rrgfvfvtrs gkmvglrqia rtfsqaglqa aipfkitphv lratavteyk rlgcsdsdim 301 kvtghatakm ifaydkssre dnaskkmali
```

By "pgp8" and the like is meant a polynucleotide encoding a Pgp8 polypeptide or fragment thereof.

"Pharmaceutically acceptable" refers to approved or approvable by a regulatory agency of the Federal or a state government or listed in the U.S. Pharmacopeia or other generally recognized pharmacopeia for use in animals, including humans.

"Pharmaceutically acceptable excipient, carrier or diluent" refers to an excipient, carrier or diluent that can be administered to a subject, together with an agent, and which does not destroy the pharmacological activity thereof and is nontoxic when administered in doses sufficient to deliver a therapeutic amount of the agent.

As used herein, "plasmid" refers to a circular nucleic acid molecule capable of autonomous replication in a host cell.

As used herein, "plurality" is understood to mean more than one. For example, a plurality refers to at least two, three, four, five, or more.

A "polypeptide" or "peptide" as used herein is understood as two or more independently selected natural or non-natural amino acids joined by a covalent bond (e.g., a peptide bond). A peptide can include 2, 3, 4, 5, 6, 7, 8, 9, 10, 11, 12, 13, 14, 15, 16, 17, 18, 19, 20, or more natural or non-natural amino acids joined by peptide bonds. Polypeptides as described herein include full length proteins (e.g., fully processed proteins) as well as shorter amino acids sequences (e.g., fragments of naturally occurring proteins or synthetic polypeptide fragments).

As used herein, the terms "prevent," "preventing," "prevention," "prophylactic treatment," and the like, refer to reducing the probability of developing a disease or condition in a subject, who does not have, but is at risk of or susceptible to developing a disease or condition. For example, prevention can be understood as to limit, reduce the rate or degree of onset, or inhibit the development of at least one sign or symptom of a disease or condition particularly in a subject prone to developing the disease or disorder, e.g., due to geographic location, lack of clean water, immunosuppressed state, etc. A subject immunized with the attenuated bacterial vaccine of the invention will not develop the disease for at least 1 year, 2 years, 3 years, 4 years, 5 years, 6 years, 7 years, 8 years, 9 years, 10 years, or more after immunization. Prevention can require the administration of more than one dose of an agent or therapeutic. Prevention may occur in only a subset of individuals to whom the vaccine is administered who are subsequently exposed to the pathogen. There may be a delay from the time of administration until the vaccine is effective in preventing productive bacterial infection. Such considerations are well known to those of skill in the art.

As used herein, a "recombinant" bacteria is a non-naturally occurring bacteria that is generated using molecular biology techniques.

By "reduces" is meant a negative alteration of at least about 10%, 25%, 50%, 75%, or 100% relative to a reference.

By "reference" is meant a standard or control condition.

A "sample" as used herein refers to a biological material that is isolated from its environment (e.g., blood or tissue from an animal, cells, or conditioned media from tissue culture). In embodiments, the sample is suspected of containing, or known to contain an analyte, such as a bacteria, an antibody, or a product from a reporter construct. A sample can also be a partially purified fraction of a tissue or bodily fluid. A reference sample can be a "normal" sample, from a donor not having the disease or condition fluid, or from a normal tissue in a subject having the disease or condition, or an untreated subject (e.g., a subject not treated with the vaccine). A reference sample can also be taken at a "zero time point" prior to contacting the cell or subject with the agent or therapeutic intervention to be tested.

By "specifically binds" is meant recognition and binding to a target (e.g., polypeptide, cell, and the like), but which does not substantially recognize and bind other molecules in a sample, for example, a biological sample.

A subject "suffering from or suspected of suffering from" a specific disease, condition, or syndrome has a sufficient number of risk factors or presents with a sufficient number or combination of signs or symptoms of the disease, condition, or syndrome such that a competent individual would diagnose or suspect that the subject was suffering from the disease, condition, or syndrome. Methods for identification of subjects suffering from or suspected of suffering from pathogenic infections is within the ability of those in the art. Subjects suffering from, and suspected of suffering from, a specific disease, condition, or syndrome are not necessarily two distinct groups.

As used herein, "susceptible to" or "prone to" or "predisposed to" a specific disease or condition and the like refers to an individual who based on genetic, environmental, health, and/or other risk factors is more likely to develop a disease or condition than the general population. An increase in likelihood of developing a disease may be an increase of about 10%, 20%, 50%, 100%, 150%, 200%, or more.

The term "therapeutic effect" refers to some extent of relief of one or more of the symptoms of a disorder or its associated pathology. The term refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for an infection if, after receiving a therapeutic amount of an antibody according to the methods of the present invention, the patient shows observable and/or measurable reduction in or absence of one or more of the following: reduction in the number of infected cells or absence of the infected cells; reduction in the percent of total cells that are infected; relief to some extent of one or more of the symptoms associated with the specific infection (e.g., symptoms associated with influenza infection); reduced morbidity and mortality, and improvement in quality of life issues. The above parameters for assessing successful treatment and improvement in the disease are readily measurable by routine procedures familiar to a physician.

"Therapeutically effective amount," as used herein refers to an amount of an agent which is effective, upon single or multiple dose administration to a cell or subject, to confer a therapeutic effect in a subject. For example, a therapeutically effective amount will prolong the survivability of the subject with a disorder, reduce one or more signs or symptoms of the disorder, prevent or delay onset/progression of the disorder, and the like beyond that expected in the absence of such treatment. A physician or veterinarian having ordinary skill in the art can readily determine and prescribe the "therapeutically effective amount" (e.g., $ED_{50}$) of an agent. For example, the physician or veterinarian could start doses of the compounds of the invention employed in a pharmaceutical composition at levels lower than that required in order to achieve the desired therapeutic effect and gradually increase the dosage until the desired effect is achieved.

As used herein, the terms "treat," "treating," "treatment," and the like refer to reducing or ameliorating a disorder and/or symptoms associated therewith. By "ameliorate" is meant decrease, suppress, attenuate, diminish, arrest, or stabilize the development or progression of a disease. It will be appreciated that, although not precluded, treating a disorder or condition does not require that the disorder, condition or symptoms associated therewith be completely eliminated.

As used herein, "vaccine" refers to a preparation of immunogenic material capable of stimulating an immune response, administered for the prevention, amelioration, or treatment of disease, such as an infectious disease. The immunogenic material may include, for example, attenuated or killed microorganisms (such as an attenuated or inactivated bacteria), or antigenic proteins, peptides or DNA derived from them. Vaccines may elicit both prophylactic (preventative) and therapeutic responses. Methods of administration vary according to the vaccine, but may include inoculation, ingestion, inhalation or other forms of administration. Inoculations can be delivered by any of a number of routes, including parenteral, such as intravenous, subcutaneous or intramuscular. Vaccines may be administered with an adjuvant to boost the immune response.

The term "vector" means a construct that is capable of delivering and expressing, one or more gene(s) or sequence(s) of interest in a host cell. Examples of vectors include, but are not limited to, bacterial vectors, viral vectors, naked DNA or RNA expression vectors, plasmids, cosmid or phage vectors, DNA or RNA expression vectors associated with cationic condensing agents, DNA or RNA expression vectors encapsulated in liposomes, and certain eukaryotic cells, such as producer cells.

The term "expression vector" is meant to refer to a vector, such as a plasmid or viral particle, which is capable of promoting expression as well as replication of a foreign or heterologous nucleic acid incorporated therein. In embodiments, the nucleic acid to be expressed is "operably linked" to a promoter and/or enhancer, and is subject to transcription regulatory control by the promoter and/or enhancer.

The term "vector priming" is meant to refer to the delivery of a gene encoding a vaccine antigen by way of an expression vector. In certain embodiments, it means that the vector-based gene delivery will be a first exposure to the immunogenic composition, followed by one or more subsequent "booster" dose or doses of immunogenic composition.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Nucleic acids encoding the various polypeptide sequences can readily be determined by one of skill in the art, and any sequence encoding any of the polypeptide sequences of the invention falls within the scope of the invention.

The recitation of an embodiment for a variable or aspect herein includes that embodiment as any single embodiment or in combination with any other embodiments or portions thereof. For example, any compositions or methods provided herein can be combined with one or more of any of the other compositions and methods provided herein.

DESCRIPTION OF THE DRAWINGS

FIGS. 1A-1D show the construction of chlamydial shuttle vector and eight individual ORF knockout vectors. FIGS. 1A and 1B are plasmid maps. The circles represent the plasmid from C. trachomatis L2 (pgp7, ori, pgp6, pgp5, pgp4, pgp3, pgp2, pgp1, pgp8) and the vector pBR322 (tet', bla, ori, rap, tet). The coding sequences are shown below and the direction of transcription are represented by the arrows on the circle. Functional elements of pBRCT including β-lactamase gene (bla), gene coding for the ROP protein (rop), origin of replication (ori), inactivated tetracycline resistance gene (tet'), and eight pL2 ORFs (pgp1-8) are as shown. FIG. 1A depicts the pBRCT vector, which harbors eight intact pL2 plasmid ORFs. FIG. 1B provides a schematic representation of deleted regions (white) of pBRCT in eight individual plasmid-ORF knockout vectors. FIG. 1C is an agarose electrophoresis of SalI digestion products of pBRCT and eight cleaned PCR products. The top band in each lane represents the expected size amplicon for the construction of each individual plasmid ORF knockout vector. FIG. 1D is an agarose gel of whole length PCR products of eight pL2 ORFs. The results show that each individual plasmid ORF knockout vector lacks one correct size amplicon at its corresponding position in agarose electrophoresis, in comparison to pBRCT having all expected size amplicons.

FIGS. 2A-2G are phase microscopy images of McCoy cell monolayers infected with L2, L2R and various stable transformants of L2R at an MOI of 0.3 after 40 h p.i. (magnification, ×200). Arrows indicate mature inclusions. FIGS. 2A-2G show that the inclusions of L2R and L2RpΔpgp4 mutants are morphologically distinct from those of L2, L2Rp+, L2RpΔpgp3, L2RpΔpgp5 and L2RpΔpgp7. FIGS. 2A'-2G' show that the inclusions of L2R and L2RpΔpgp4 mutants stain negative for glycogen.

FIG. 3A is a plot showing the results from principal-component analysis (PCA) of quantile normalized microarray data of strains L2, L2R, L2p+, L2RpΔpgp4 and L2RpΔpgp5 at 24 h p.i. Each colored circle represents all C. trachomatis data produced from a single chip, where grouping and separation of replicates and strains, respectively, are demonstrated [red, L2; blue, L2R; green, L2Rp+; purple, L2RpΔpgp4; orange, L2RpΔpgp5]. FIG. 3B is a hierarchical cluster analysis of microarray results. The results show a close association in gene expression between L2RpΔpgp4 and L2R. 39 genes that passed the test criteria in at least one microarray comparison analysis were selected. Four pairwise comparisons were performed, L2R vs L2, L2Rp+vs L2, L2pΔpgp4 vs L2Rp+, and L2RpΔpgp5 vs L2Rp+. A signal intensity of yellow color indicates equal intensity compared to the referenced intensity of L2, with red indicating a greater intensity and blue indicating a reduced intensity.

FIGS. 5A-5I show the nucleic acid and amino acid sequences of J03321. FIG. 5A is the nucleic acid sequence of J03321. FIG. 5B is the amino acid sequence of Pgp1 for J03321. FIG. 5C is the amino acid sequence of Pgp2 for J03321. FIG. 5D is the amino acid sequence of Pgp3 for J03321. FIG. 5E is the amino acid sequence of Pgp4 for J03321. FIG. 5F is the amino acid sequence of Pgp5 for J03321. FIG. 5G is the amino acid sequence of Pgp6 for J03321. FIG. 5H is the amino acid sequence of Pgp7 for J03321. FIG. 5I is the amino acid sequence of Pgp8 for J03321.

FIGS. 6A-6I show the nucleic acid and amino acid sequences of NC_010286. FIG. 6A is the nucleic acid sequence of NC_010286. FIG. 6B is the amino acid sequence of Pgp1 for NC_010286. FIG. 6C is the amino acid sequence of Pgp2 for NC_010286. FIG. 6D is the amino acid sequence of Pgp3 for NC_010286. FIG. 6E is the amino acid sequence of Pgp4 for NC_010286. FIG. 6F is the amino acid sequence of Pgp5 for NC_010286. FIG. 6G is the amino acid sequence of Pgp6 for NC_010286. FIG. 6H is the amino acid sequence of Pgp7 for NC_010286. FIG. 6I is the amino acid sequence of Pgp8 for NC_010286.

FIGS. 7A-7I show the nucleic acid and amino acid sequences of NC_010285. FIG. 7A is the nucleic acid sequence of NC_010285. FIG. 7B is the amino acid sequence of Pgp1 for NC_010285. FIG. 7C is the amino acid sequence of Pgp2 for NC_010285. FIG. 7D is the amino acid sequence of Pgp3 for NC_010285. FIG. 7E is the amino acid sequence of Pgp4 for NC_010285. FIG. 7F is the amino acid sequence of Pgp5 for NC_010285. FIG. 7G is the amino acid sequence of Pgp6 for NC_010285. FIG. 7H is the amino acid sequence of Pgp7 for NC_010285. FIG. 7I is the amino acid sequence of Pgp8 for NC_010285.

FIGS. 8A-8I show the nucleic acid and amino acid sequences of NC_012625. FIG. 8A is the nucleic acid sequence of NC_012625. FIG. 8B is the amino acid sequence of Pgp1 for NC_012625. FIG. 8C is the amino acid sequence of Pgp2 for NC_012625. FIG. 8D is the amino acid sequence of Pgp3 for NC_012625. FIG. 8E is the amino acid sequence of Pgp4 for NC_012625. FIG. 8F is the amino acid sequence of Pgp5 for NC_012625. FIG. 8G is the amino acid sequence of Pgp6 for NC_012625. FIG. 8H is the amino acid sequence of Pgp7 for NC_012625. FIG. 8I is the amino acid sequence of Pgp8 for NC_012625.

FIGS. 9A-9I show the nucleic acid and amino acid sequences of NC_012626. FIG. 9A is the nucleic acid sequence of NC_012626. FIG. 9B is the amino acid sequence of Pgp1 for NC_012626. FIG. 9C is the amino acid sequence of Pgp2 for NC_012626. FIG. 9D is the amino acid sequence of Pgp3 for NC_012626. FIG. 9E is the amino acid sequence of Pgp4 for NC_012626. FIG. 9F is the amino acid sequence of Pgp5 for NC_012626. FIG. 9G is the amino acid sequence of Pgp6 for NC_012626. FIG. 9H is the amino acid sequence of Pgp7 for NC_012626. FIG. 9I is the amino acid sequence of Pgp8 for NC_012626.

FIGS. 10A-10I show the nucleic acid and amino acid sequences of NC_012627. FIG. 10A is the nucleic acid sequence of NC_012627. FIG. 10B is the amino acid sequence of Pgp1 for NC_012627. FIG. 10C is the amino acid sequence of Pgp2 for NC_012627. FIG. 10D is the amino acid sequence of Pgp3 for NC_012627. FIG. 10E is the amino acid sequence of Pgp4 for NC_012627. FIG. 10F is the amino acid sequence of Pgp5 for NC_012627. FIG. 10G is the amino acid sequence of Pgp6 for NC_012627. FIG. 10H is the amino acid sequence of Pgp7 for NC_012627. FIG. 10I is the amino acid sequence of Pgp8 for NC_012627.

FIGS. 11A-11I show the nucleic acid and amino acid sequences of NC_012630. FIG. 11A is the nucleic acid sequence of NC_012630. FIG. 11B is the amino acid sequence of Pgp1 for NC_012630. FIG. 11C is the amino acid sequence of Pgp2 for NC_012630. FIG. 11D is the amino acid sequence of Pgp3 for NC_012630. FIG. 11E is the amino acid sequence of Pgp4 for NC_012630. FIG. 11F is the amino acid sequence of Pgp5 for NC_012630. FIG. 11G is the amino acid sequence of Pgp6 for NC_012630. FIG. 11H is the amino acid sequence of Pgp7 for NC_012630. FIG. 10I is the amino acid sequence of Pgp8 for NC_012630.

FIGS. 12A-12I show the nucleic acid and amino acid sequences of NC_012631. FIG. 12A is the nucleic acid sequence of NC_012631. FIG. 12B is the amino acid sequence of Pgp1 for NC_012631. FIG. 12C is the amino acid sequence of Pgp2 for NC_012631. FIG. 12D is the amino acid sequence of Pgp3 for NC_012631. FIG. 12E is the amino acid sequence of Pgp4 for NC_012631. FIG. 12F is the amino acid sequence of Pgp5 for NC_012631. FIG. 12G is the amino acid sequence of Pgp6 for NC_012631. FIG. 12H is the amino acid sequence of Pgp7 for NC_012631. FIG. 12I is the amino acid sequence of Pgp8 for NC_012631.

FIGS. 13A-13I show the nucleic acid and amino acid sequences of HE603210. FIG. 13A is the nucleic acid sequence of HE603210. FIG. 13B is the amino acid sequence of Pgp1 for HE603210. FIG. 13C is the amino acid sequence of Pgp2 for HE603210. FIG. 13D is the amino acid sequence of Pgp3 for HE603210. FIG. 13E is the amino acid sequence of Pgp4 for HE603210. FIG. 13F is the amino acid sequence of Pgp5 for HE603210. FIG. 13G is the amino acid sequence of Pgp6 for HE603210. FIG. 13H is the amino acid sequence of Pgp7 for HE603210. FIG. 13I is the amino acid sequence of Pgp8 for HE603210.

FIGS. 14A-14I show the nucleic acid and amino acid sequences of HE603212. FIG. 14A is the nucleic acid sequence of HE603212. FIG. 14B is the amino acid sequence of Pgp1 for HE603212. FIG. 14C is the amino acid sequence of Pgp2 for HE603212. FIG. 14D is the amino acid sequence of Pgp3 for HE603212. FIG. 14E is the amino acid sequence of Pgp4 for HE603212. FIG. 14F is the amino acid sequence of Pgp5 for HE603212. FIG. 14G is the amino acid sequence of Pgp6 for HE603212. FIG. 14H is the amino acid sequence of Pgp7 for HE603212. FIG. 14I is the amino acid sequence of Pgp8 for HE603212.

FIGS. 15A-15I show the nucleic acid and amino acid sequences of HE603213. FIG. 15A is the nucleic acid sequence of HE603213. FIG. 15B is the amino acid sequence of Pgp1 for HE603213. FIG. 15C is the amino acid sequence of Pgp2 for HE603213. FIG. 15D is the amino acid sequence of Pgp3 for HE603213. FIG. 15E is the amino acid sequence of Pgp4 for HE603213. FIG. 15F is the amino acid sequence of Pgp5 for HE603213. FIG. 15G is the amino acid sequence of Pgp6 for HE603213. FIG. 15H is the amino acid sequence of Pgp7 for HE603213. FIG. 15I is the amino acid sequence of Pgp8 for HE603213.

FIGS. 16A-16I show the nucleic acid and amino acid sequences of HE603218. FIG. 16A is the nucleic acid sequence of HE603218. FIG. 16B is the amino acid sequence of Pgp1 for HE603218. FIG. 16C is the amino acid sequence of Pgp2 for HE603218. FIG. 16D is the amino acid sequence of Pgp3 for HE603218. FIG. 16E is the amino acid sequence of Pgp4 for HE603218. FIG. 16F is the amino acid sequence of Pgp5 for HE603218. FIG. 16G is the amino acid sequence of Pgp6 for HE603218. FIG. 16H is the amino acid sequence of Pgp7 for HE603218. FIG. 16I is the amino acid sequence of Pgp8 for HE603218.

FIGS. 17A-17I show the nucleic acid and amino acid sequences of HE603227. FIG. 17A is the nucleic acid sequence of HE603227. FIG. 17B is the amino acid sequence of Pgp1 for HE603227. FIG. 17C is the amino acid sequence of Pgp2 for HE603227. FIG. 17D is the amino acid sequence of Pgp3 for HE603227. FIG. 17E is the amino acid sequence of Pgp4 for HE603227. FIG. 17F is the amino acid sequence of Pgp5 for HE603227. FIG. 17G is the amino acid sequence of Pgp6 for HE603227. FIG. 17H is the amino acid sequence of Pgp7 for HE603227. FIG. 17I is the amino acid sequence of Pgp8 for HE603227.

FIGS. 18A-18H show the nucleic acid and amino acid sequences of HE603228. FIG. 18A is the nucleic acid sequence of HE603228. FIG. 18B is the amino acid sequence of Pgp1 for HE603228. FIG. 18C is the amino acid sequence of Pgp2 for HE603228. FIG. 18D is the amino acid sequence of Pgp3 for HE603228. FIG. 18E is the amino acid sequence of Pgp4 for HE603228. FIG. 18F is the amino acid sequence of Pgp5 for HE603228. FIG. 18G is the amino acid sequence of Pgp6 for HE603228. FIG. 18H is the amino acid sequence of Pgp8 for HE603228.

FIGS. 19A-19I show the nucleic acid and amino acid sequences of HE603230. FIG. 19A is the nucleic acid sequence of HE603230. FIG. 19B is the amino acid sequence of Pgp1 for HE603230. FIG. 19C is the amino acid sequence of Pgp2 for HE603230. FIG. 19D is the amino acid sequence of Pgp3 for HE603230. FIG. 19E is the amino acid sequence of Pgp4 for HE603230. FIG. 19F is the amino acid sequence of Pgp5 for HE603230. FIG. 19G is the amino acid sequence of Pgp6 for HE603230. FIG. 19H is the amino acid sequence of Pgp7 for HE603230. FIG. 19I is the amino acid sequence of Pgp8 for HE603230.

FIGS. 20A-20I show the nucleic acid and amino acid sequences of HE603232. FIG. 20A is the nucleic acid sequence of HE603232. FIG. 20B is the amino acid sequence of Pgp1 for HE603232. FIG. 20C is the amino acid sequence of Pgp2 for HE603232. FIG. 20D is the amino acid sequence of Pgp3 for HE603232. FIG. 20E is the amino acid sequence of Pgp4 for HE603232. FIG. 20F is the amino acid sequence of Pgp5 for HE603232. FIG. 20G is the amino acid sequence of Pgp6 for HE603232. FIG. 20H is the amino acid sequence of Pgp7 for HE603232. FIG. 20I is the amino acid sequence of Pgp8 for HE603232.

FIGS. 21A-21I show the nucleic acid and amino acid sequences of HE603234. FIG. 21A is the nucleic acid sequence of HE603234. FIG. 21B is the amino acid sequence of Pgp1 for HE603234. FIG. 21C is the amino acid sequence of Pgp2 for HE603234. FIG. 21D is the amino acid sequence of Pgp3 for HE603234. FIG. 21E is the amino acid sequence of Pgp4 for HE603234. FIG. 21F is the amino acid sequence of Pgp5 for HE603234. FIG. 21G is the amino acid sequence of Pgp6 for HE603234. FIG. 21H is the amino acid sequence of Pgp7 for HE603234. FIG. 21I is the amino acid sequence of Pgp8 for HE603234.

FIGS. 22A-22I show the nucleic acid and amino acid sequences of HE603235. FIG. 22A is the nucleic acid sequence of HE603235. FIG. 22B is the amino acid sequence of Pgp1 for HE603235. FIG. 22C is the amino acid sequence of Pgp2 for HE603235. FIG. 22D is the amino acid sequence of Pgp3 for HE603235. FIG. 22E is the amino acid sequence of Pgp4 for HE603235. FIG. 22F is the amino acid sequence of Pgp5 for HE603235. FIG. 22G is the amino acid sequence of Pgp6 for HE603235. FIG. 22H is the amino acid sequence of Pgp7 for HE603235. FIG. 22I is the amino acid sequence of Pgp8 for HE603235.

FIGS. 23A-23I show the nucleic acid and amino acid sequences of HE603236. FIG. 23A is the nucleic acid sequence of HE603236. FIG. 23B is the amino acid sequence of Pgp1 for HE603236. FIG. 23C is the amino acid sequence of Pgp2 for HE603236. FIG. 23D is the amino acid sequence of Pgp3 for HE603236. FIG. 23E is the amino acid sequence of Pgp4 for HE603236. FIG. 23F is the amino acid sequence of Pgp5 for HE603236. FIG. 23G is the amino acid sequence of Pgp6 for HE603236. FIG. 23H is the amino acid sequence of Pgp7 for HE603236. FIG. 23I is the amino acid sequence of Pgp8 for HE603236.

FIGS. 24A-24I show the nucleic acid and amino acid sequences of HE603238. FIG. 24A is the nucleic acid sequence of HE603238. FIG. 24B is the amino acid sequence of Pgp1 for HE603238. FIG. 24C is the amino acid sequence of Pgp2 for HE603238. FIG. 24D is the amino acid sequence of Pgp3 for HE603238. FIG. 24E is the amino acid sequence of Pgp4 for HE603238. FIG. 24F is the amino acid sequence of Pgp5 for HE603238. FIG. 24G is the amino acid sequence of Pgp6 for HE603238. FIG. 24H is the amino acid sequence of Pgp7 for HE603238. FIG. 24I is the amino acid sequence of Pgp8 for HE603238.

FIGS. 25A-25I show the nucleic acid and amino acid sequences of HE603209. FIG. 25A is the nucleic acid sequence of HE603209. FIG. 25B is the amino acid sequence of Pgp1 for HE603209. FIG. 25C is the amino acid sequence of Pgp2 for HE603209. FIG. 25D is the amino acid sequence of Pgp3 for HE603209. FIG. 25E is the amino acid sequence of Pgp4 for HE603209. FIG. 25F is the amino acid sequence of Pgp5 for HE603209. FIG. 25G is the amino acid sequence of Pgp6 for HE603209. FIG. 25H is the amino acid sequence of Pgp7 for HE603209. FIG. 25I is the amino acid sequence of Pgp8 for HE603209.

FIGS. 26A-26I show the nucleic acid and amino acid sequences of CP000052. FIG. 26A is the nucleic acid sequence of CP000052. FIG. 26B is the amino acid sequence of Pgp1 for CP000052. FIG. 26C is the amino acid sequence of Pgp2 for CP000052. FIG. 26D is the amino acid sequence of Pgp3 for CP000052. FIG. 26E is the amino acid sequence of Pgp4 for CP000052. FIG. 26F is the amino acid sequence of Pgp5 for CP000052. FIG. 26G is the amino acid sequence of Pgp6 for CP000052. FIG. 26H is the amino acid sequence of Pgp7 for CP000052. FIG. 26I is the amino acid sequence of Pgp8 for CP000052.

FIGS. 27A-27I show the nucleic acid and amino acid sequences of CP002402. FIG. 27A is the nucleic acid sequence of CP002402. FIG. 27B is the amino acid sequence of Pgp1 for CP002402. FIG. 27C is the amino acid sequence of Pgp2 for CP002402. FIG. 27D is the amino acid sequence of Pgp3 for CP002402. FIG. 27E is the amino acid sequence of Pgp4 for CP002402. FIG. 27F is the amino acid sequence of Pgp5 for CP002402. FIG. 27G is the amino acid sequence of Pgp6 for CP002402. FIG. 27H is the amino acid sequence of Pgp7 for CP002402. FIG. 27I is the amino acid sequence of Pgp8 for CP002402.

FIGS. 28A-28I show the nucleic acid and amino acid sequences of NC_012629. FIG. 28A is the nucleic acid sequence of NC_012629. FIG. 28B is the amino acid sequence of Pgp1 for NC_012629. FIG. 28C is the amino acid sequence of Pgp2 for NC_012629. FIG. 28D is the amino acid sequence of Pgp3 for NC_012629. FIG. 28E is the amino acid sequence of Pgp4 for NC_012629. FIG. 28F is the amino acid sequence of Pgp5 for NC_012629. FIG. 28G is the amino acid sequence of Pgp6 for NC_012629. FIG. 28H is the amino acid sequence of Pgp7 for NC_012629. FIG. 28I is the amino acid sequence of Pgp8 for NC_012629.

FIGS. 29A-29I show the nucleic acid and amino acid sequences of CP002053. FIG. 29A is the nucleic acid sequence of CP002053. FIG. 29B is the amino acid sequence of Pgp1 for CP002053. FIG. 29C is the amino acid sequence of Pgp2 for CP002053. FIG. 29D is the amino acid sequence of Pgp3 for CP002053. FIG. 29E is the amino acid sequence of Pgp4 for CP002053. FIG. 29F is the amino acid sequence of Pgp5 for CP002053. FIG. 29G is the amino acid sequence of Pgp6 for CP002053. FIG. 29H is the amino acid sequence of Pgp7 for CP002053. FIG. 29I is the amino acid sequence of Pgp8 for CP002053.

FIGS. 30A-30I show the nucleic acid and amino acid sequences of NC_010029. FIG. 30A is the nucleic acid sequence of NC_010029. FIG. 30B is the amino acid sequence of Pgp1 for NC_010029. FIG. 30C is the amino acid sequence of Pgp2 for NC_010029. FIG. 30D is the amino acid sequence of Pgp3 for NC_010029. FIG. 30E is the amino acid sequence of Pgp4 for NC_010029. FIG. 30F is the amino acid sequence of Pgp5 for NC_010029. FIG. 30G is the amino acid sequence of Pgp6 for NC_010029. FIG. 30H is the amino acid sequence of Pgp7 for NC_010029. FIG. 30I is the amino acid sequence of Pgp8 for NC_010029.

DETAILED DESCRIPTION OF THE INVENTION

Figure 1C:
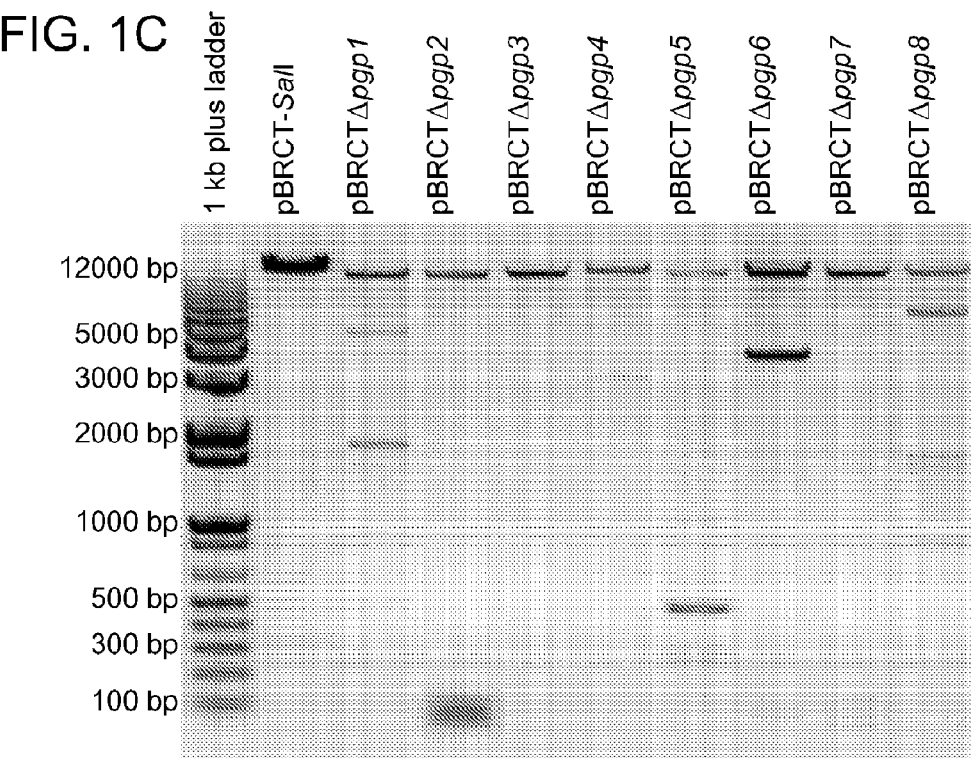

The invention features nucleic acids, attenuated pathogens, compositions, methods, and kits that are useful for treating and preventing infection by a pathogenic agent (e.g., *chlamydia*).

The invention is based, at least in part, on the discovery that the ORFs of the *chlamydia* genome can be grouped into two sets: essential ORFs (pgp1-2, -6 and -8) and non-essential ORFs (pgp3-5 and -7) for plasmid maintenance in tissue culture. *Chlamydia trachomatis* causes chronic inflammatory diseases of the eye and genital tract of global medical importance. The chlamydial plasmid plays an important role in the pathophysiology of these diseases as plasmid-deficient organisms are highly attenuated. The plasmid encodes both noncoding RNAs and eight conserved ORFs of undefined function. To understand plasmid gene function, plasmid shuttle vectors were generated with deletions in each of the eight ORFs. The individual deletion mutants were used to transform chlamydiae and the transformants were characterized in terms of plasmid biology and transcriptional profiling. As described herein, pgp1-2, -6 and -8 are essential for plasmid maintenance while the other ORFs can be deleted and the plasmid stably maintained. Furthermore, a pgp4 knockout mutant exhibits an in vitro phenotype similar to its isogenic plasmid-less strain in terms of abnormal inclusion morphology and lack of glycogen accumulation. Microarray and qRT-PCR analysis revealed that pgp4 is involved in transcriptional regulation of multiple chromosomal genes; including the glycogen synthase gene glgA. Based on these results, it was determined that Pgp1 is a plasmid replicative helicase, Pgp2 is a plasmid replication protein, Pgp4 is a transcriptional regulator of virulence associated chromosomal genes, and Pgp6-8 are plasmid partitioning proteins. These findings are the basis of the novel vectors described herein. In addition to their use as a vaccine vector, the novel vectors can be used to develop live attenuated pathogenic vaccines (e.g., chlamydial vaccines). Accordingly, the invention provides novel vectors, attenuated pathogens, compositions, methods, and kits for preventing and/or treating infection by a pathogenic agent (e.g., *chlamydia*).

*Chlamydia*

*Chlamydia trachomatis* is a mucosotropic obligate intracellular bacterial pathogen of humans that is the major cause of bacterial sexually transmitted disease and trachoma, the World's leading cause of infectious preventable blindness (Schachter, *N. Engl. J. Med.* 298:540-549 (1978)). Chlamydial STI is also an important risk factor for the transmission of HIV (Laga et al., *AIDS,* 7:95-102 (1993)). *C. trachomatis* STI are caused by 8 antigenically variable serovars D, E, F, G, H, I, J, and K, and trachoma by 3 serovars A, B, and C (Schachter, *N. Engl. J. Med.* 298:428-435 (1978)). Current infection control strategies use nucleic acid amplification tests for detection and antibiotic treatment (CDC, MMWR, 51 (RR15) 1-27 (2002)). Paradoxically, despite this aggressive approach, the prevalence of chlamydial infections continues to increase (Brunham et. al., *Journal of Infectious Diseases* 192:1836-1844 (2005)) arguing for alternative control measures. A vaccine would be the most effective approach to control chlamydial STI (Brunham and Rey-Ladino, *Nature Reviews Immunology* 5:149-161 (2005)). However, to date, there is no FDA approved or licensed vaccine for chlamydial STI.

Chlamydial vaccine development has proven exceptionally challenging due to the organisms obligate intracellular life style and biphasic developmental biology, complex antigenic structure representing multiple targets and effector mechanisms of protective immunity, its strict host and mucosal tropism, and the lack of a small animal model for pre-clinical studies of immunity and pathogenesis. These challenges have circumvented meaningful progress in classical recombinant subunit vaccine development and present a strong argument for the development of a live-attenuated vaccine (LAV) (Morrison and Caldwell, *Infect. Immun.* 70:2741-2751 (2002)). Another, most challenging aspect to vaccine development, is that natural immunity elicits both protective and pathologic immune responses. Protective immunity is primarily serovar-specific whereas pathologic immunity is directed against common shared antigens. A safe and efficacious vaccine must selectively elicit serovar-specific protective immunity without inducing pathologic immunity (Schachter, *Rev. Infect. Dis.* 7:713-716 (1985)).

The primary serotyping antigen is the chlamydial major membrane protein (MOMP). MOMP is also a dominant neutralizing target and protective antigen (Zhang et. al., *J. Immunol.* 138:575-581 (1987)). Optimum MOMP immunogenicity and protection requires that MOMP be presented in a conformationally correct structure (Pal et. al., *Infect. Immun.* 73:8153-8160 (2005)). Non-structural secreted antigenically common antigens are also protective and immunogenicity is also greatest against correctly folded secreted molecules (Chen et. al., *J. Bacteriol.* 192:6017-6024 (2010)). An effective vaccine may therefore need to incorporate correctly folded serovariable MOMP and should be capable of target mucosal T cell and antibody-mediated immunity. Importantly, an effective vaccine must avoid damaging pathologic immunity, a challenge that is solved by the present invention.

The chlamydial 7.5 kb plasmid is a cause of pathologic immunity following chlamydial infection of mice and non-human primates (O'Connell et. al., *J. Immunol.* 179:4027-4037 (2007); Carlson et. al., *Infect. Immun.* 76:2273-2283 (2008); and Kari et. al., *J. Exp. Med.* 208:2217-2223 (2011)). The chlamydial plasmid has 8 open reading frames (ORF) that encode for 8 plasmid protein genes (pgp). As described herein, pgp3 and pgp4 are virulence genes that promote pathology whereas the other pgp are non-virulence determinants that are essential to plasmid replication or stable in situ maintenance. Thus, a plasmid lacking pgp3 and/or pgp4 is attenuated for virulence but maintains the ability to transform and replicate in chlamydiae. Like plasmid-deficient LAV, which elicit a robust host response and confers protection against virulent plasmid bearing organisms (Kari et. al., *J. Exp. Med.,* 208:2217-2223 (2011)), the attenuated plasmids described herein can be used to confer protection against pathogenic agents (e.g., *chlamydia*). The attenuated plasmids are suitable for use to clone and express protective antigen(s) (e.g., MOMP). The novel vectors are suitable as vaccine vectors, and can be used to deliver target antigen(s) to a cell or infectious pathogen. For example, the vector can be used to transform a single chlamydial strain to either directly express a protective antigen(s) or to insert the protective genes into the host chromosome by allelic exchange. The vector can also be used to deliver antigens from non-chlamydial pathogenic agents.

Although plasmid-deficient LAV strains are highly attenuated and induce immunity against virulent plasmid bearing organisms (Kari et. al., *J. Exp. Med.,* 208:2217-2223 (2011)), such plasmid-deficient LAV strains can be less stable than their plasmid bearing counterparts. As described herein, the attenuated plasmids of the present invention contain non-virulence determinants that are essential to plasmid replication and/or maintenance. As such, improved live attenuated LAV strains can be made by introducing the attenuated plasmids of the present invention into plasmid-deficient pathogenic strains.

The chlamydial 7.5 kb plasmid and variants related thereto are well-known in the art. Exemplary nucleotide sequences and their corresponding Pgp1-8 sequences can be found at NCBI Accession Nos. J03321, NC_010286, NC_010285, NC_012625, NC_012626, NC_012627, NC_012630, NC_012631, HE603210, HE603212, HE603213, HE603218, HE603227, HE603228, HE603230, HE603232, HE603234, HE603235, HE603236, HE603238, HE603209, CP000052, CP002402, NC_012629, CP002053, and NC_010029 (see also FIGS. 5-30).

One of skill in the art would readily understand how make and practice the attenuated vectors of the present invention using conventional techniques of molecular biology (including recombinant techniques), microbiology, cell biology, biochemistry, and immunology. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991).

In addition, use of the attenuated vectors in combination with a chlamydial strain is well within the purview of the skilled artisan. Clinical *chlamydia* isolates and live-attenuated *chlamydia* strains are well known in the art, including plasmid-deficient LAV strains (see Kari et. al., *J. Exp. Med.,* 208:2217-2223 (2011); Carlson, J. et al., *Infect. Immun.* 76:2273-83 (2008); and O'Connell, C. M. et al., *Microbiology.* 152:1601-7 (2006)). One of skill in the art can readily use the attenuated vector to transform these *chlamydia* strains. For example, the attenuated vector can be introduced and maintained as an episomal vector in the *chlamydia* transformant. The attenuated vector can optionally contain a target antigen, which is maintained as part of the episomal vector in the *chlamydia* transformant. Alternatively, the target antigen from the attenuated vector can be integrated into the *chlamydia* chromosome by allelic exchange. Particularly useful methodologies for practicing these aspects of the invention may be found in Stibitz, S., *Methods Enzymol.* 235:458-65 (1994), the contents of which are hereby incorporated by reference its entirety.

Polynucleotides and Polypeptides

As described herein, the present invention features novel attenuated vectors and variants thereof. The attenuated vectors can be directly used to transform a cell/infectious pathogen, and/or can be used to express heterologous antigens (e.g., antigens from infectious agents, including *chlamydia*) in vivo or in vitro. In embodiments, the recombinant attenuated vectors can be used in an immunogenic composition (e.g., vaccine) to prevent or treat infection by a pathogen.

The variant of an attenuated vector can be a naturally occurring allelic variant of the polynucleotide or a non-naturally occurring variant of the polynucleotide. In embodiments, the attenuated vector can have a coding sequence that is a naturally occurring allelic variant of the coding sequence of the disclosed polypeptides. As known in the art, an allelic variant is an alternate form of a polynucleotide sequence that have, for example, a substitution, deletion, or addition of one or more nucleotides, which does not substantially alter the function of the encoded polypeptide(s).

In embodiments, the attenuated vectors can comprise the coding sequence for a target antigen fused in the same reading frame to a polynucleotide that aids, for example, in expression and secretion of a polypeptide from a host cell (e.g., a leader sequence which functions as a secretory sequence for controlling transport of a polypeptide from the cell). The polypeptide having a leader sequence is a preprotein and can have the leader sequence cleaved by the host cell to form the mature form of the polypeptide. The polynucleotides can also encode for a proprotein which is the mature protein plus additional 5' amino acid residues. A mature protein having a prosequence is a proprotein and is an inactive form of the protein. Once the prosequence is cleaved an active mature protein remains. Additional regulatory elements (e.g., transcriptional and translational expression control sequences) are well-known in the art. For example, the attenuated vectors can contain additional promoters to control the transcription of a sequence, a ribosome binding site to permit translation, and the like.

In embodiments, the attenuated vectors can comprise the coding sequence for a target antigen fused in the same reading frame to a marker sequence that allows, for example, for purification of the encoded polypeptide/target antigen. For example, the marker sequence can be a hexa-histidine tag supplied by a pQE-9 vector to provide for purification of the mature polypeptide fused to the marker in the case of a bacterial host, or the marker sequence can be a hemagglutinin (HA) tag derived from the influenza hemagglutinin protein when a mammalian host (e.g., COS-7 cells) is used. Additional tags include, but are not limited to, Calmodulin tags, FLAG tags, Myc tags, S tags, SBP tags, Softag 1, Softag 3, V5 tag, Xpress tag, Isopeptag, SpyTag, Biotin Carboxyl Carrier Protein (BCCP) tags, GST tags, fluorescent protein tags (e.g., green fluorescent protein tags), maltose binding protein tags, Nus tags, Strep-tag, thioredoxin tag, TC tag, Ty tag, and the like.

In embodiments, the present invention provides attenuated vectors derived from J03321, NC_010286, NC_010285, NC_012625, NC_012626, NC_012627, NC_012630, NC_012631, HE603210, HE603212, HE603213, HE603218, HE603227, HE603228, HE603230, HE603232, HE603234, HE603235, HE603236, HE603238, HE603209, CP000052, CP002402, NC_012629, CP002053, and NC_010029 (see FIGS. 5-30). For example, the attenuated vector can have a nucleotide sequence that is at least 80% identical, at least 85% identical, at least 90% identical, at least 95% identical, or at least 96%, 97%, 98% or 99% identical to SEQ ID NOS: 9, 18, 27, 36, 45, 54, 63, 72, 81, 90, 99, 108, 117, 126, 134, 143, 152, 161, 170, 179, 188, 197, 206, 215, 224, or 233 lacking the pgp3, pgp4, and/or pgp5 gene.

By a polynucleotide having a nucleotide sequence at least, for example, 95% "identical" to a reference nucleotide sequence (e.g., an attenuated vector of SEQ ID NO: X, Y, or Z) is intended that the nucleotide sequence of the polynucleotide is identical to the reference sequence except that the polynucleotide sequence can include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence can be deleted or substituted with another nucleotide, or a number of nucleotides up to 5% of the total nucleotides in the reference sequence can be inserted into the reference sequence. These mutations of the reference sequence can occur at the amino- or carboxy-terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 80% identical, at least 85% identical, at least 90% identical, and in some embodiments, at least 95%, 96%, 97%, 98%, or 99% identical to a reference sequence can be determined conventionally using known computer programs such as the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman, Advances in Applied Mathematics 2: 482 489 (1981), to find the best segment of homology between two sequences. When using Bestfit or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5% of the total number of nucleotides in the reference sequence are allowed.

The attenuated vector variants can contain alterations in the coding regions, non-coding regions, or both. In some embodiments, the attenuated vector variants contain alterations that produce silent substitutions, additions, or deletions, but do not alter the properties or activities of the encoded polypeptide(s). In some embodiments, attenuated vector variants are produced by silent substitutions due to the degeneracy of the genetic code. Attenuated vector variants can be produced for a variety of reasons, e.g., to optimize codon expression for a particular host (change codons in bacterial plasmid to those preferred by a mammalian host such as a human cell).

Methods for making the attenuated vectors of the present invention are well-known in the art. Suitable methods for making the attenuated vectors include chemical synthesis using an oligonucleotide synthesizer. In addition, the attenuated vector can be expressed in a suitable transformed host. The host cell can be any cell (e.g., prokaryotic or eukaryotic cell) that is capable of expressing the attenuated vector. Such cells are known in the art and transformation and transfection methods are described, e.g., in Ausubel et al. (supra). The attenuated vectors of the invention can also be expressed in a transgenic organism, such as a transgenic animal. By "transgenic" is meant any cell that includes a DNA sequence which is inserted by artifice into a cell and becomes part of the genome of the organism which develops from that cell, or part of a heritable extra chromosomal array. As used herein, transgenic organisms may be either transgenic vertebrates, such as domestic mammals (e.g., sheep, cow, goat, horse, and the like), mice, rats, and the like. Methods for modifying the attenuated vectors of the invention for expression in a particular host cell or transgenic animal will is within the purview of the skilled artisan (e.g., insertion of expression specific regulatory elements).

In embodiments, the synthesized or expressed vectors can be subsequently purified using standard purification (e.g., biochemistry, immunology, etc.) techniques.

Target antigen(s) can be inserted into the attenuated vectors of the present invention using standard molecular biology techniques, e.g., methodology provided in Cloning Vectors: A Laboratory Manual (P. H. Pouwels et al., 1985, Supp. 1987). The target antigen can be any antigen capable of eliciting an immune response in a subject. For example, the target antigen can be an antigen (e.g., polypeptide or fragment thereof) from an infectious pathogen. For example, the antigen can be a protective T cell antigen. Such antigens are well-known in the art it is within the purview of the skilled artisan to use any desired protective T cell antigen in the present invention.

In embodiments, the antigen is from a mucosal pathogen (e.g., *chlamydia*, a retrovirus (e.g., human immunodeficiency virus), herpes simplex virus, *Neisseria gonorrhoeae, Treponema pallidum, Ureaplasma urealyticum, Haemophilus vaginalis, Mycoplasma genitalium*, and the like. In embodiments, the target antigen is an antigen from a *chlamydia* strain. For example, suitable *chlamydia* antigens include, but are not limited to, the major outer membrane protein (MOMP) or fragments thereof, polymorphic membrane proteins (PMP) or fragments thereof, High Temperature Requirement protein A (HtrA) or fragments thereof, and the like. In some embodiments, the attenuated vectors express (or overexpress) the target antigen.

Methods of Treatment

The present invention provides methods for treating or preventing infection by an infectious pathogen (e.g., *chlamydia*).

In aspects, the invention features methods for inducing an immune response in a subject. In embodiments, the methods involve administering an effective amount of an attenuated vector described herein, a cell or infectious pathogen containing the attenuated vector, or a composition containing the attenuated vector and/or transformed cell/pathogen. In embodiments, the methods prevent or treat an infection (e.g., a viral infection, a bacterial infection, a fungal infection, or a parasitic infection).

In aspects, the invention features methods for modulating an immune response in a subject. In embodiments, the methods involve administering an effective amount of an attenuated vector described herein, a cell or infectious pathogen containing the attenuated vector, or a composition containing the attenuated vector and/or transformed cell/pathogen. In embodiments, the methods prevent or treat an infection (e.g., a viral infection, a bacterial infection, a fungal infection, or a parasitic infection).

In aspects, the invention features methods for treating or preventing an infection by an infectious pathogen in a subject (e.g., is a viral infection, a bacterial infection, a fungal infection, or a parasitic infection). In embodiments, the methods involve administering an effective amount of an attenuated vector described herein, a cell or pathogen containing the attenuated vector, or a composition containing the attenuated vector and/or transformed cell/pathogen. In embodiments, methods involve generating an immune response in the subject, wherein the immune response prevents or treats the infection.

In aspects, the invention features methods for immunizing a subject against an infectious pathogen. In embodiments, the methods involve administering an effective amount of an attenuated vector described herein, a cell or pathogen containing the attenuated vector, or a composition containing the attenuated vector and/or transformed cell/pathogen. In embodiments, methods involve generating an immune response in the subject, wherein the immune response prevents or treats infection by the pathogen.

In any of the above aspects or embodiments, the pathogen can be a virus, a bacteria, a parasite, or a fungus. In some embodiments, the infectious pathogen is a mucosal pathogen. In some embodiments, the pathogen is *chlamydia*, human immunodeficiency virus, herpes simplex virus, *Neisseria gonorrhoeae, Treponema pallidum, Ureaplasma urealyticum, Haemophilus vaginalis,* or *Mycoplasma genitalium*.

In embodiments, the infectious pathogen is *chlamydia*. In certain embodiments, the pathogen is *Chlamydia trachomatis* (*C. trachomatis*) A, B, Ba, C, D, E, F, G, H, I, J, K, L1, L2, L3 serovariant. In some embodiments, the pathogen is a *C. trachomatis* D, E, F, G, H, I, J, and K serovariant.

In any of the above aspects or embodiments, the subject can be a mammal (e.g., human).

In any of the above aspects or embodiments, the isolated nucleic acid, infectious pathogen, or composition can be administered systemically or locally. In embodiments, the isolated nucleic acid, attenuated pathogen, or composition is administered by intramuscular injection, intradermal injection, intravenous injection, or subcutaneous injection.

In any of the above aspects or embodiments, the isolated nucleic acid, attenuated pathogen, or composition is administered in a prime boost regimen.

Pharmaceutical Compositions

The invention provides for pharmaceutical compositions containing the novel attenuated vectors described herein, including attenuated pathogens expressing the novel vectors. In embodiments, the pharmaceutical compositions contain a pharmaceutically acceptable carrier, excipient, or diluent, which includes any pharmaceutical agent that does not itself induce the production of an immune response harmful to a subject receiving the composition, and which may be administered without undue toxicity. As used herein, the term "pharmaceutically acceptable" means being approved by a regulatory agency of the Federal or a state government or listed in the U.S. Pharmacopia, European Pharmacopia or other generally recognized pharmacopia for use in mammals, and more particularly in humans. These compositions can be useful for treating and/or preventing infection by a pathogenic agent (e.g., *chlamydia*).

A thorough discussion of pharmaceutically acceptable carriers, diluents, and other excipients is presented in *Remington's Pharmaceutical Sciences* (17th ed., Mack Publishing Company) and *Remington: The Science and Practice of Pharmacy* (21st ed., Lippincott Williams & Wilkins), which are hereby incorporated by reference. The formulation of the pharmaceutical composition should suit the mode of administration. In embodiments, the pharmaceutical composition is suitable for administration to humans, and can be sterile, non-particulate and/or non-pyrogenic.

Pharmaceutically acceptable carriers, excipients, or diluents include, but are not limited, to saline, buffered saline, dextrose, water, glycerol, ethanol, sterile isotonic aqueous buffer, and combinations thereof.

Wetting agents, emulsifiers and lubricants, such as sodium lauryl sulfate and magnesium stearate, as well as coloring agents, release agents, coating agents, sweetening, flavoring and perfuming agents, preservatives, and antioxidants can also be present in the compositions.

Examples of pharmaceutically-acceptable antioxidants include, but are not limited to: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

In embodiments, the pharmaceutical composition is provided in a solid form, such as a lyophilized powder suitable for reconstitution, a liquid solution, suspension, emulsion, tablet, pill, capsule, sustained release formulation, or powder.

In embodiments, the pharmaceutical composition is supplied in liquid form, for example, in a sealed container indicating the quantity and concentration of the active ingredient in the pharmaceutical composition. In related embodiments, the liquid form of the pharmaceutical composition is supplied in a hermetically sealed container.

Methods for formulating the pharmaceutical compositions of the present invention are conventional and well-known in the art (see Remington and Remington's). One of skill in the art can readily formulate a pharmaceutical composition having the desired characteristics (e.g., route of administration, biosafety, and release profile).

Methods for preparing the pharmaceutical compositions include the step of bringing into association the active ingredient with a pharmaceutically acceptable carrier and, optionally, one or more accessory ingredients. The pharmaceutical compositions can be prepared by uniformly and intimately bringing into association the active ingredient with liquid carriers, or finely divided solid carriers, or both, and then, if necessary, shaping the product. Additional methodology for preparing the pharmaceutical compositions, including the preparation of multilayer dosage forms, are described in *Ansel's Pharmaceutical Dosage Forms and Drug Delivery Systems* (9th ed., Lippincott Williams & Wilkins), which is hereby incorporated by reference.

Immunogenic Compositions

In aspects, the pharmaceutical composition is an immunogenic composition, including a vaccine, which is useful as a therapeutic and prophylactic for the treatment or prevention of infection by a pathogen (e.g., bacteria, virus, fungus, parasite, and the like). The immunogenic compositions contain an attenuated vector of the present invention, or an attenuated pathogen expressing the novel vector. Advantageously, these immunogenic compositions can be tailored to treat any pathogen.

In embodiments, at least one antigen (and optionally a plurality of antigens) from the infectious pathogen is delivered via the attenuated vector. In related embodiments, the attenuated vector and the target antigen(s) are administered as polynucleotides.

In embodiments, the attenuated vector is introduced into an attenuated pathogen (e.g., a plasmid deficient LAV strain). Attenuation of pathogens can reduce the stability and/or replicative capacity of the infectious agent. The presence of the attenuated vector enhances the stability and/or reproduction of the attenuated pathogen. In some related embodiments, the attenuated vector can contain at least one antigen, and optionally a plurality of antigens. The additional antigen(s) can enhance the immunogenicity of the attenuated pathogen.

Optionally, the immunogenic compositions are formulated with an oil to generate a water-in-oil emulsion product.

The immunogenic compositions of the invention induce a systemic immune response and/or a mucosal immune response. In embodiments, an immune response can be a T cell or a B cell (e.g., antibody) immune response. In embodiments, the T cell immune response comprises increased T cell cytolytic function or reduction in T regulatory cells. Inflammatory conditions cause the release of chemokines and other factors that, by upregulating and activating adhesion molecules on inflammatory cells, promote adhesion, morphological changes, and extravasation concurrent with chemotaxis through the tissues. In embodiments, an immune response involves the production of high avidity antibodies specific for the immunogen(s).

In embodiments, the immune response is an antibody response. In related embodiments, the immune response involves the production of high avidity antibodies specific for the immunogen(s).

In embodiments, the immune response is a systemic immune response.

The immune response may be a T cell immune response. In embodiments, the T cell immune response can comprise increased T cell cytolytic function. In embodiments, the T cell immune response comprises a reduction in T regulatory cells. In embodiments, the T cell immune response can modulate the pattern of the immune response.

In embodiments, the immune response is a T cell response and an antibody response.

The immunogenic compositions described herein can contain a pharmaceutically acceptable carrier, including any suitable diluent or excipient, which includes any pharmaceutical agent that does not itself induce the production of an immune response harmful to a subject receiving the composition, and which may be administered without undue toxicity. As used herein, the term "pharmaceutically acceptable" means being approved by a regulatory agency of the Federal or a state government or listed in the U.S. Pharmacopia, European Pharmacopia or other generally recognized pharmacopia for use in mammals, and more particularly in humans. These compositions can be useful as a vaccine and/or antigenic compositions for inducing a protective and/or therapeutic immune response in a subject.

Pharmaceutically acceptable carriers include but are not limited to saline, buffered saline, dextrose, water, glycerol, ethanol, sterile isotonic aqueous buffer, and combinations thereof. A thorough discussion of pharmaceutically acceptable carriers, diluents, and other excipients is presented in Remington's Pharmaceutical Sciences (Mack Pub. Co. N.J. current edition), which is hereby incorporated by reference. Suitable carriers include, but are not limited to, large macromolecules that are slowly metabolized, such as proteins, polysaccharides, polylactic acids, polyglycolic acids, polymeric amino acids, amino acid copolymers, lipid aggregates, and inactive virus particles. Such carriers are well known to those skilled in the art. These carriers may also function as adjuvants. Further suitable agents useful for pH maintenance, solution stabilization, or for the regulation of osmotic pressure include, but are not limited to, salts, such as sodium chloride, or potassium chloride, and carbohydrates, such as glucose, galactose or mannose, and the like.

The immunogenic composition, if desired, can also contain auxiliary substances such as wetting or emulsifying agents, pH buffering agents, and the like. The composition can be a solid form, such as a lyophilized powder suitable for reconstitution, a liquid solution, suspension, emulsion, tablet, pill, capsule, sustained release formulation, or powder. Oral formulations can include standard carriers such as pharmaceutical grades of mannitol, lactose, starch, magnesium stearate, sodium saccharine, cellulose, magnesium carbonate, and the like.

In embodiments, the immunogenic composition is supplied in liquid form, for example in a sealed container indicating the quantity and concentration of the immunogen (and optionally adjuvant) in the composition. In embodiments, the liquid form of the immunogenic composition is supplied in a hermetically sealed container.

In addition to the attenuated vector, additional adjuvants can be used in the immunogenic composition.

Adjuvants enhance the immunogenicity of an antigen but are not necessarily immunogenic themselves. Adjuvants enhance the host's immune response to an immunogen(s). Adjuvants may act by retaining the antigen locally near the site of administration to produce a depot effect facilitating a slow, sustained release of antigen to cells of the immune system. Adjuvants can also attract cells of the immune system to an antigen depot and stimulate such cells to elicit immune responses.

Examples suitable adjuvants for use in the immunogenic compositions described herein include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% Tween 80, and 0.5% Span 85 (optionally containing various amounts of MTP-PE (see below), although not required) formulated into submicron particles using a microfluidizer such as Model 110y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mo.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as STIMULON™ (Cambridge Bioscience, Worcester, Mass.) may be used or particles generated therefrom such as ISCOMs (immunostimulating complexes); (4) Complete Freunds Adjuvant (CFA) and Incomplete Freunds Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition, e.g., monophosphoryl lipid A. In embodiments, the adjuvant is alum or monophosphoryl lipid A.

In embodiments, the adjuvant is a biomolecule (e.g., cytokines, interferons, and the like). In related embodiments, the biomolecule is encoded in the attenuated vector.

Chitosans are derivatives of chitin or poly-N-acetyl-D-glucosamine in which the greater proportion of the N-acetyl groups have been removed through hydrolysis. European Patent Application 460 020, which is hereby incorporated by reference, discloses pharmaceutical formulations including chitosans as mucosal absorption enhancers. As such, chitosans and chitosan derivatives are further examples of adjuvants suitable for use in the present invention.

One of skill in the art would be familiar with choosing the appropriate pharmaceutically acceptable carrier(s), excipient(s), and diluent(s) for use in the immunogenic compositions of the invention. Furthermore, one of skill in the art would be familiar with choosing the appropriate adjuvant(s) for use in the immunogenic compositions of the invention.

Methods of Delivery

The pharmaceutical compositions of the invention can be administered to a subject by oral and non-oral means (e.g., topically, transdermally, or by injection). Such modes of administration and the methods for preparing an appropriate pharmaceutical composition for use therein are described in *Gibaldi's Drug Delivery Systems in Pharmaceutical Care* (1st ed., American Society of Health-System Pharmacists), which is hereby incorporated by reference.

In embodiments, the pharmaceutical compositions are administered orally in a solid form.

Pharmaceutical compositions suitable for oral administration can be in the form of capsules, cachets, pills, tablets, lozenges (using a flavored basis, usually sucrose and *acacia* or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and *acacia*) and/or as mouth washes and the like, each containing a predetermined amount of a compound(s) described herein, a derivative thereof, or a pharmaceutically acceptable salt or prodrug thereof as the active ingredient(s). The active ingredient can also be administered as a bolus, electuary, or paste.

In solid dosage forms for oral administration (e.g., capsules, tablets, pills, dragees, powders, granules and the like), the active ingredient is mixed with one or more pharmaceutically acceptable carriers, excipients, or diluents, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or *acacia*; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets, and pills, the pharmaceutical compositions can also comprise buffering agents. Solid compositions of a similar type can also be prepared using fillers in soft and hard-filled gelatin capsules, and excipients such as lactose or milk sugars, as well as high molecular weight polyethylene glycols and the like.

A tablet can be made by compression or molding, optionally with one or more accessory ingredients. Compressed tablets can be prepared using binders (for example, gelatin or hydroxypropylmethyl cellulose), lubricants, inert diluents, preservatives, disintegrants (for example, sodium starch glycolate or cross-linked sodium carboxymethyl cellulose), surface-actives, and/or dispersing agents. Molded tablets can be made by molding in a suitable machine a mixture of the powdered active ingredient moistened with an inert liquid diluent.

The tablets and other solid dosage forms, such as dragees, capsules, pills, and granules, can optionally be scored or prepared with coatings and shells, such as enteric coatings and other coatings well-known in the art.

The pharmaceutical compositions can also be formulated so as to provide slow, extended, or controlled release of the active ingredient therein using, for example, hydroxypropylmethyl cellulose in varying proportions to provide the desired release profile, other polymer matrices, liposomes and/or microspheres. The pharmaceutical compositions can also optionally contain opacifying agents and may be of a composition that releases the active ingredient(s) only, or preferentially, in a certain portion of the gastrointestinal tract, optionally, in a delayed manner. Examples of embedding compositions include polymeric substances and waxes. The active ingredient can also be in micro-encapsulated form, if appropriate, with one or more pharmaceutically acceptable carriers, excipients, or diluents well-known in the art (see, e.g., Remington and Remington's).

The pharmaceutical compositions can be sterilized by, for example, filtration through a bacteria-retaining filter, or by incorporating sterilizing agents in the form of sterile solid compositions which can be dissolved in sterile water, or some other sterile injectable medium immediately before use.

In embodiments, the pharmaceutical compositions are administered orally in a liquid form.

Liquid dosage forms for oral administration of an active ingredient include pharmaceutically acceptable emulsions, microemulsions, solutions, suspensions, syrups and elixirs. In addition to the active ingredient, the liquid dosage forms can contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof. In addition to inert diluents, the liquid pharmaceutical compositions can include adjuvants such as wetting agents, emulsifying and suspending agents, sweetening, flavoring, coloring, perfuming and preservative agents, and the like.

Suspensions, in addition to the active ingredient(s) can contain suspending agents such as, but not limited to, ethoxylated isostearyl alcohols, polyoxyethylene sorbitol and sorbitan esters, microcrystalline cellulose, aluminum metahydroxide, bentonite, agar-agar and tragacanth, and mixtures thereof.

In embodiments, the pharmaceutical compositions are administered by non-oral means such as by topical application, transdermal application, injection, and the like. In related embodiments, the pharmaceutical compositions are administered parenterally by injection, infusion, or implantation (e.g., intravenous, intramuscular, intraarticular, subcutaneous, and the like).

Compositions for parenteral use can be presented in unit dosage forms, e.g. in ampoules or in vials containing several doses, and in which a suitable preservative can be added. Such compositions can be in form of a solution, a suspension, an emulsion, an infusion device, a delivery device for implantation, or it can be presented as a dry powder to be reconstituted with water or another suitable vehicle before use. One or more co-vehicles, such as ethanol, can also be employed. Apart from the active ingredient(s), the compositions can contain suitable parenterally acceptable carriers and/or excipients or the active ingredient(s) can be incorporated into microspheres, microcapsules, nanoparticles, liposomes, or the like for controlled release. Furthermore, the compositions can also contain suspending, solubilising, stabilising, pH-adjusting agents, and/or dispersing agents.

The pharmaceutical compositions can be in the form of sterile injections. To prepare such a composition, the active ingredient is dissolved or suspended in a parenterally acceptable liquid vehicle. Exemplary vehicles and solvents include, but are not limited to, water, water adjusted to a suitable pH by addition of an appropriate amount of hydrochloric acid, sodium hydroxide or a suitable buffer, 1,3-butanediol, Ringer's solution and isotonic sodium chloride solution. The pharmaceutical composition can also contain one or more preservatives, for example, methyl, ethyl or n-propyl p-hydroxybenzoate. To improve solubility, a dissolution enhancing or solubilising agent can be added or the solvent can contain 10-60% w/w of propylene glycol or the like.

The pharmaceutical compositions can contain one or more pharmaceutically acceptable sterile isotonic aqueous or nonaqueous solutions, dispersions, suspensions or emulsions, or sterile powders, which can be reconstituted into sterile injectable solutions or dispersions just prior to use. Such pharmaceutical compositions can contain antioxidants; buffers; bacteriostats; solutes, which render the formulation isotonic with the blood of the intended recipient; suspending agents; thickening agents; preservatives; and the like.

Examples of suitable aqueous and nonaqueous carriers, which can be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

In some embodiments, in order to prolong the effect of an active ingredient, it is desirable to slow the absorption of the compound from subcutaneous or intramuscular injection. This can be accomplished by the use of a liquid suspension of crystalline or amorphous material having poor water solubility. The rate of absorption of the active ingredient then depends upon its rate of dissolution which, in turn, can depend upon crystal size and crystalline form. Alternatively, delayed absorption of a parenterally-administered active ingredient is accomplished by dissolving or suspending the compound in an oil vehicle. In addition, prolonged absorption of the injectable pharmaceutical form can be brought about by the inclusion of agents that delay absorption such as aluminum monostearate and gelatin.

Controlled release parenteral compositions can be in form of aqueous suspensions, microspheres, microcapsules, magnetic microspheres, oil solutions, oil suspensions, emulsions, or the active ingredient can be incorporated in biocompatible carrier(s), liposomes, nanoparticles, implants or infusion devices.

Materials for use in the preparation of microspheres and/or microcapsules include biodegradable/bioerodible polymers such as polyglactin, poly-(isobutyl cyanoacrylate), poly(2-hydroxyethyl-L-glutamine) and poly(lactic acid).

Biocompatible carriers which can be used when formulating a controlled release parenteral formulation include carbohydrates such as dextrans, proteins such as albumin, lipoproteins or antibodies.

Materials for use in implants can be non-biodegradable, e.g., polydimethylsiloxane, or biodegradable such as, e.g., poly(caprolactone), poly(lactic acid), poly(glycolic acid) or poly(ortho esters).

In embodiments, the active ingredient(s) are administered by aerosol. This is accomplished by preparing an aqueous aerosol, liposomal preparation, or solid particles containing the compound. A nonaqueous (e.g., fluorocarbon propellant) suspension can be used. The pharmaceutical composition can also be administered using a sonic nebulizer, which would minimize exposing the agent to shear, which can result in degradation of the compound.

Ordinarily, an aqueous aerosol is made by formulating an aqueous solution or suspension of the active ingredient(s) together with conventional pharmaceutically-acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Dosage forms for topical or transdermal administration of an active ingredient(s) includes powders, sprays, ointments, pastes, creams, lotions, gels, solutions, patches and inhalants. The active ingredient(s) can be mixed under sterile conditions with a pharmaceutically acceptable carrier, and with any preservatives, buffers, or propellants as appropriate.

Transdermal patches suitable for use in the present invention are disclosed in *Transdermal Drug Delivery: Developmental Issues and Research Initiatives* (Marcel Dekker Inc., 1989) and U.S. Pat. Nos. 4,743,249, 4,906,169, 5,198,223, 4,816,540, 5,422,119, 5,023,084, which are hereby incorporated by reference. The transdermal patch can also be any transdermal patch well-known in the art, including transscrotal patches. Pharmaceutical compositions in such transdermal patches can contain one or more absorption enhancers or skin permeation enhancers well-known in the art (see, e.g., U.S. Pat. Nos. 4,379,454 and 4,973,468, which are hereby incorporated by reference). Transdermal therapeutic systems for use in the present invention can be based on iontophoresis, diffusion, or a combination of these two effects.

Transdermal patches have the added advantage of providing controlled delivery of active ingredient(s) to the body. Such dosage forms can be made by dissolving or dispersing the active ingredient(s) in a proper medium. Absorption enhancers can also be used to increase the flux of the active ingredient across the skin. The rate of such flux can be controlled by either providing a rate controlling membrane or dispersing the active ingredient(s) in a polymer matrix or gel.

Such pharmaceutical compositions can be in the form of creams, ointments, lotions, liniments, gels, hydrogels, solutions, suspensions, sticks, sprays, pastes, plasters and other kinds of transdermal drug delivery systems. The compositions can also include pharmaceutically acceptable carriers or excipients such as emulsifying agents, antioxidants, buffering agents, preservatives, humectants, penetration enhancers, chelating agents, gel-forming agents, ointment bases, perfumes, and skin protective agents.

Examples of emulsifying agents include, but are not limited to, naturally occurring gums, e.g. gum *acacia* or gum tragacanth, naturally occurring phosphatides, e.g. soybean lecithin and sorbitan monooleate derivatives.

Examples of antioxidants include, but are not limited to, butylated hydroxy anisole
(BHA), ascorbic acid and derivatives thereof, tocopherol and derivatives thereof, and cysteine.

Examples of preservatives include, but are not limited to, parabens, such as methyl or propyl p-hydroxybenzoate and benzalkonium chloride.

Examples of humectants include, but are not limited to, glycerin, propylene glycol, sorbitol and urea.

Examples of penetration enhancers include, but are not limited to, propylene glycol, DMSO, triethanolamine, N,N-dimethylacetamide, N,N-dimethylformamide, 2-pyrrolidone and derivatives thereof, tetrahydrofurfuryl alcohol, propylene glycol, diethylene glycol monoethyl or monomethyl ether with propylene glycol monolaurate or methyl laurate, eucalyptol, lecithin, Transcutol®, and Azone®.

Examples of chelating agents include, but are not limited to, sodium EDTA, citric acid and phosphoric acid.

Examples of gel forming agents include, but are not limited to, Carbopol, cellulose derivatives, bentonite, alginates, gelatin and polyvinylpyrrolidone.

In addition to the active ingredient(s), the ointments, pastes, creams, and gels of the present invention can contain excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain excipients such as lactose, talc, silicic acid, aluminum hydroxide, calcium silicates and polyamide powder, or mixtures of these substances. Sprays can additionally contain customary propellants, such as chlorofluorohydrocarbons, and volatile unsubstituted hydrocarbons, such as butane and propane.

Injectable depot forms are made by forming microencapsule matrices of compound(s) of the invention in biodegradable polymers such as polylactide-polyglycolide. Depending on the ratio of compound to polymer, and the nature of the particular polymer employed, the rate of compound release can be controlled. Examples of other biodegradable polymers include poly(orthoesters) and poly(anhydrides). Depot injectable formulations are also prepared by entrapping the drug in liposomes or microemulsions which are compatible with body tissue.

Subcutaneous implants are well-known in the art and are suitable for use in the present invention. Subcutaneous implantation methods are preferably non-irritating and mechanically resilient. The implants can be of matrix type, of reservoir type, or hybrids thereof. In matrix type devices, the carrier material can be porous or non-porous, solid or semi-solid, and permeable or impermeable to the active compound or compounds. The carrier material can be biodegradable or may slowly erode after administration. In some instances, the matrix is non-degradable but instead relies on the diffusion of the active compound through the matrix for the carrier material to degrade. Alternative subcutaneous implant methods utilize reservoir devices where the active compound or compounds are surrounded by a rate controlling membrane, e.g., a membrane independent of component concentration (possessing zero-order kinetics). Devices consisting of a matrix surrounded by a rate controlling membrane also suitable for use.

Both reservoir and matrix type devices can contain materials such as polydimethylsiloxane, such as Silastic™, or other silicone rubbers. Matrix materials can be insoluble polypropylene, polyethylene, polyvinyl chloride, ethylvinyl acetate, polystyrene and polymethacrylate, as well as glycerol esters of the glycerol palmitostearate, glycerol stearate, and glycerol behenate type. Materials can be hydrophobic or hydrophilic polymers and optionally contain solubilising agents.

Subcutaneous implant devices can be slow-release capsules made with any suitable polymer, e.g., as described in U.S. Pat. Nos. 5,035,891 and 4,210,644, which are hereby incorporated by reference.

In general, at least four different approaches are applicable in order to provide rate control over the release and transdermal permeation of a drug compound. These approaches are: membrane-moderated systems, adhesive diffusion-controlled systems, matrix dispersion-type systems and microreservoir systems. It is appreciated that a controlled release percutaneous and/or topical composition can be obtained by using a suitable mixture of these approaches.

In a membrane-moderated system, the active ingredient is present in a reservoir which is totally encapsulated in a shallow compartment molded from a drug-impermeable laminate, such as a metallic plastic laminate, and a rate-controlling polymeric membrane such as a microporous or a non-porous polymeric membrane, e.g., ethylene-vinyl acetate copolymer. The active ingredient is released through the rate controlling polymeric membrane. In the drug reservoir, the active ingredient can either be dispersed in a solid polymer matrix or suspended in an unleachable, viscous liquid medium such as silicone fluid. On the external surface of the polymeric membrane, a thin layer of an adhesive polymer is applied to achieve an intimate contact of the transdermal system with the skin surface. The adhesive polymer is preferably a polymer which is hypoallergenic and compatible with the active drug substance.

In an adhesive diffusion-controlled system, a reservoir of the active ingredient is formed by directly dispersing the active ingredient in an adhesive polymer and then by, e.g., solvent casting, spreading the adhesive containing the active ingredient onto a flat sheet of substantially drug-impermeable metallic plastic backing to form a thin drug reservoir layer.

A matrix dispersion-type system is characterized in that a reservoir of the active ingredient is formed by substantially homogeneously dispersing the active ingredient in a hydrophilic or lipophilic polymer matrix. The drug-containing polymer is then molded into disc with a substantially well-defined surface area and controlled thickness. The adhesive polymer is spread along the circumference to form a strip of adhesive around the disc.

A microreservoir system can be considered as a combination of the reservoir and matrix dispersion type systems. In this case, the reservoir of the active substance is formed by first suspending the drug solids in an aqueous solution of water-soluble polymer and then dispersing the drug suspension in a lipophilic polymer to form a multiplicity of unleachable, microscopic spheres of drug reservoirs.

Any of the above-described controlled release, extended release, and sustained release compositions can be formulated to release the active ingredient in about 30 minutes to about 1 week, in about 30 minutes to about 72 hours, in about 30 minutes to 24 hours, in about 30 minutes to 12 hours, in about 30 minutes to 6 hours, in about 30 minutes to 4 hours, and in about 3 hours to 10 hours. In embodiments, an effective concentration of the active ingredient(s) is sustained in a subject for 4 hours, 6 hours, 8 hours, 10 hours, 12 hours, 16 hours, 24 hours, 48 hours, 72 hours, or more after administration of the pharmaceutical compositions to the subject.

Dosage and Administration

The compositions (e.g., immunogenic preparations) are administered in a manner compatible with the dosage formulation, and in such amount as will be therapeutically affective, protective and immunogenic.

The compositions may be administered through different routes, including, but not limited to, oral, parenteral, buccal and sublingual, rectal, aerosol, nasal, intramuscular, subcutaneous, intradermal, and topical. The term parenteral as used herein includes, for example, intraocular, subcutaneous, intraperitoneal, intracutaneous, intravenous, intramuscular, intraarticular, intraarterial, intrasynovial, intrastemal, intrathecal, intralesional, and intracranial injection, or other infusion techniques.

In embodiments, the compositions formulated according to the present invention are formulated and delivered in a manner to evoke a systemic immune response. For example, the pharmaceutical composition can be systemically administered, e.g., by subcutaneous or intramuscular injection using a needle and syringe, or a needleless injection device. The pharmaceutical composition can also be systemically administered by intravenous injection using a needle and syringe.

Thus, in embodiments, the formulations are prepared by uniformly and intimately bringing into association the active ingredient with liquid carriers. Formulations suitable for parenteral administration include aqueous and non-aqueous sterile injection solutions which may contain anti-oxidants, buffers, bacteriostats and solutes which render the formulation isotonic with the blood of the intended recipient, and aqueous and non-aqueous sterile suspensions which may include suspending agents and thickening agents. The formulations may be presented in unit-dose or multi-dose containers, for example, sealed ampoules and vials, and may be stored in a freeze-dried (lyophilized) condition requiring only the addition of the sterile liquid carrier, for example, water for injections, immediately prior to use. Extemporaneous injection solutions and suspensions may be prepared from sterile powders, granules and tablets commonly used by one of ordinary skill in the art.

The compositions may be administered in different forms, including, but not limited to, solutions, emulsions and suspensions, microspheres, particles, microparticles, nanoparticles, liposomes, and the like.

The compositions are administered in a manner compatible with the dosage formulation, and in such amount as will be therapeutically effective (e g, immunogenic and protective). The quantity to be administered depends on the subject to be treated, including, for example, the capacity of the individual's immune system to synthesize antibodies and/or to produce a cell-mediated immune response. Precise amounts of active ingredients required to be administered depend on the judgment of the practitioner. However, suitable dosage ranges are readily determinable by one skilled in the art and may be of the order of micrograms to milligrams of the active ingredient(s) per vaccination. Suitable regimes for initial administration and booster doses are also variable, but may include an initial administration followed by subsequent booster administrations. The dosage may also depend on the route of administration and will vary according to the size of the host.

Exemplary unit dosage formulations are those containing a dose or unit, or an appropriate fraction thereof, of the administered ingredient. It should be understood that in addition to the ingredients mentioned herein, the formulations of the present invention may include other agents commonly used by one of ordinary skill in the art.

The compositions are administered in one or more doses as required to achieve the desired effect. Thus, the compositions may be administered in 1, 2, 3, 4, 5, or more doses. Further, the doses may be separated by any period of time, for example hours, days, weeks, months, and years.

The quantity to be administered depends on the subject to be treated. Precise amounts of active ingredient required to be administered depend on the judgment of the practitioner. However, suitable dosage ranges are readily determinable by one skilled in the art. Suitable regimes for initial administration and booster doses are also variable, but may include an initial administration followed by subsequent administrations. The dosage may also depend on the route of administration and will vary according to the size of the host.

An immunogenic composition should be administered to a subject in an amount effective to stimulate a protective immune response in the subject. Specific dosage and treatment regimens for any particular subject will depend upon a variety of factors, including the activity of the specific compound employed, the age, body weight, general health status, sex, diet, time of administration, rate of excretion, drug combination, the severity and course of the disease, condition or symptoms, the subject's disposition to the disease, condition or symptoms, method of administration, and the judgment of the treating physician. Actual dosages can be readily determined by one of ordinary skill in the art. Prime boost regimens are also contemplated in the invention, as described herein.

The immunogenic compositions can be formulated as liquids or dry powders, or in the form of microspheres.

The immunogenic compositions may be stored at temperatures of from about −100° C. to about 25° C. The composition may also be stored in a lyophilized state at different temperatures including room temperature. The composition may be sterilized through conventional means known to one of ordinary skill in the art. Such means include, but are not limited to, filtration. The composition may also be combined with bacteriostatic agents to inhibit bacterial growth.

The amount of active ingredient that may be combined with carrier materials to produce a single dosage form will vary depending upon the host treated and the particular mode of administration. In embodiments, a preparation will contain from about 1% to about 95% active compound (w/w) or from about 20% to about 80% active compound.

In embodiments, the pH of the formulation may be adjusted with pharmaceutically acceptable acids, bases, or buffers to enhance the stability of the formulated compound or its delivery form.

In embodiments, the pharmaceutical carriers may be in the form of a sterile injectable preparation, for example, as a sterile injectable aqueous or oleaginous suspension. In embodiments, the compositions are prepared in solution acceptable for use in conjunction with vaccines.

Among the acceptable vehicles and solvents that may be employed are mannitol, water, Ringer's solution and isotonic sodium chloride solution.

In addition, sterile, fixed oils are conventionally employed as a solvent or suspending medium. For this purpose, any bland fixed oil may be employed including synthetic mono- or diglycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, or carboxymethyl cellulose or similar dispersing agents which are commonly used in the formulation of pharmaceutically acceptable dosage forms such as emulsions and or suspensions. Suitable oils include, but are not limited to, mineral oil and squalene based oils (e.g., MF59 and AS03).

Other commonly used surfactants such as TWEEN® or SPAN® and/or other similar emulsifying agents or bioavailability enhancers which are commonly used in the manufacture of pharmaceutically acceptable solid, liquid, or other dosage forms may also be used for the purposes of formulation.

In embodiments, the compositions can be delivered in an exosomal delivery system. Exosomes are small membrane vesicles that are released into the extracellular environment during fusion of multivesicular bodies with plasma membrane. Exosomes are secreted by various cell types including hematopoietic cells, normal epithelial cells and even some tumor cells. Exosomes are known to carry MHC class I, various costimulatory molecules and some tetraspanins. Recent studies have shown the potential of using native exosomes as immunologic stimulants.

Also contemplated by the invention is delivery of the composition using nanoparticles. For example, the compositions provided herein can contain nanoparticles having at least one or more vectors linked thereto, e.g., linked to the surface of the nanoparticle. A composition typically includes many nanoparticles with each nanoparticle having at least one or more therapeutics linked thereto. Nanoparticles can be colloidal metals. A colloidal metal includes any water-insoluble metal particle or metallic compound dispersed in liquid water. Typically, a colloid metal is a suspension of metal particles in aqueous solution. Any metal that can be made in colloidal form can be used, including gold, silver, copper, nickel, aluminum, zinc, calcium, platinum, palladium, and iron. In some cases, gold nanoparticles are used, e.g., prepared from $HAuCl_4$. Nanoparticles can be any shape and can range in size from about 1 nm to about 10 nm in size, e.g., about 2 nm to about 8 nm, about 4 to about 6 nm, or about 5 nm in size. Methods for making colloidal metal nanoparticles, including gold colloidal nanoparticles from $HAuCl_4$, are known to those having ordinary skill in the art. For example, the methods described herein as well as those described elsewhere (e.g., US Pat. Publication Nos. 2001/005581; 2003/0118657; and 2003/0053983, which are hereby incorporated by reference) are useful guidance to make nanoparticles.

In certain cases, a nanoparticle can have two, three, four, five, six, or more molecules linked to its surface. Typically, many molecules are linked to the surface of the nanoparticle at many locations. Accordingly, when a nanoparticle is described as having, for example, two molecules linked to it, the nanoparticle has two distinct molecules, each having its own unique molecular structure, linked to its surface. In some cases, one molecule of an immunogenic composition can be linked to the nanoparticle via a single attachment site or via multiple attachment sites.

An immunogenic composition can be linked directly or indirectly to a nanoparticle surface. For example, linked directly to the surface of a nanoparticle or indirectly through an intervening linker.

Any type of molecule can be used as a linker. For example, a linker can be an aliphatic chain including at least two carbon atoms (e.g., 3, 4, 5, 6, 7, 8, 9, 10 or more carbon atoms), and can be substituted with one or more functional groups including ketone, ether, ester, amide, alcohol, amine, urea, thiourea, sulfoxide, sulfone, sulfonamide, and disulfide functionalities. In cases where the nanoparticle includes gold, a linker can be any thiol-containing molecule. Reaction of a thiol group with the gold results in a covalent sulfide (—S—) bond. Linker design and synthesis are well known in the art.

Any type of composition or any type of additional agent can be linked to a nanoparticle. Examples of agents include, without limitation, immunostimulatory agents, anti-bacterial agents, anti-viral, anti-fungal agents, anti-parasitic agents, and therapeutic agents.

In embodiments, the nanoparticle is linked to a targeting agent. A targeting functionality can allow nanoparticles to accumulate at the target at higher concentrations than in other tissues. In general, a targeting molecule can be one member of a binding pair that exhibits affinity and specificity for a second member of a binding pair. For example, an antibody or antibody fragment therapeutic agent can target a nanoparticle to a particular region or molecule of the body (e.g., the region or molecule for which the antibody is specific) while also performing a therapeutic function. In some cases, a receptor or receptor fragment can target a nanoparticle to a particular region of the body, e.g., the location of its binding pair member. Other therapeutic agents such as small molecules can similarly target a nanoparticle to a receptor, protein, or other binding site having affinity for the therapeutic agent.

When the compositions of this invention comprise a combination of a compound of the formulae described herein and one or more additional therapeutic or prophylactic agents, both the compound and the additional agent should be present at dosage levels of between about 1 to 100%, or between about 5 to 95% of the dosage normally administered in a monotherapy regimen. The additional agents may be administered separately, as part of a multiple dose regimen, from the compounds of this invention. Alternatively, those agents may be part of a single dosage form, mixed together with the compounds of this invention in a single composition.

In embodiments, the administration of the compositions of the invention elicits an immune response against the immunogen, e.g., antigen from an infectious pathogen. Typically, the dose can be adjusted within this range based on, e.g., the subject's age, the subject's health and physical condition, the capacity of the subject's immune system to produce an immune response, the subject's body weight, the subject's sex, diet, time of administration, the degree of protection desired, and other clinical factors. Those in the art can also readily address parameters such as biological half-life, bioavailability, route of administration, and toxicity when formulating the immunogenic compositions of the invention.

Prime Boost

The immunogenic compositions described herein can be administered in a prime-boost regimen. The prime-boost regimen may be a homologous prime boost (e.g., the same immunogenic composition is administered as the prime and the boost) or a heterologous prime boost (e.g., different immunogenic compositions are administered as the prime and the boost).

The priming administration (priming) is the administration of an immunogenic or immunological composition type and may comprise one, two, or more administrations. In embodiments, the priming administrations are separated by about 1, 2, 3, 4, 5, 6, or more weeks. The boost administration is the administration of a second immunogenic or immunological composition type and may comprise one, two or more administrations, and, for instance, may comprise or consist essentially of annual administrations. In embodiments, the boost administrations are separated by about 1, 2, 3, 4, 5, 6, or weeks or by about 1, 2, 3, 3, 4, 5, 6, or more months. The "boost" may be administered anytime after the priming, for example in certain embodiments from about 2 weeks to about 12 months after the priming, such as from about 6 week to about 6 months, or from about 3 to about 6 weeks after the priming, or from about 4 weeks after the priming.

One of skill in the art can readily determine the appropriate dosage, route of administration, and prime-boost schedule.

Combination Therapies

The attenuated vectors and pharmaceutical compositions described herein can also be administered in combination with another therapeutic molecule. The therapeutic molecule can be any compound used to treat an infectious pathogen.

The attenuated vector can be administered before, during, or after administration of the additional therapeutic agent. In embodiments, the attenuated vector is administered before the first administration of the additional therapeutic agent. In embodiments, the attenuated vector is administered after the first administration of the additional therapeutic agent (e.g., 1, 2, 3, 4, 5, 6, 7, 8, 9, 10, 11, 12, 13, 14 days or more). In embodiments, the attenuated vector is administered simultaneously with the first administration of the additional therapeutic agent.

The amount of therapeutic agent administered to a subject can readily be determined by the attending physician or veterinarian. Generally, an efficacious or effective amount of a attenuated vector and an additional therapeutic is determined by first administering a low dose of one or both active agents and then incrementally increasing the administered dose or dosages until a desired effect is observed (e.g., reduced respiratory pathology), with minimal or no toxic side effects. Applicable methods for determining an appropriate dose and dosing schedule for administration of a combination of the present invention are described, for example, in *Goodman and Gilman's The Pharmacological Basis of Therapeutics*, 11th Edition., supra, and in *Remington: The Science and Practice of Pharmacy*, 20th and 21st Editions, supra.

Kits

The invention provides for kits for preventing or treating infection by a pathogenic agent (e.g., *chlamydia*). In embodiments, the kit contains one or more attenuated vectors or pharmaceutical compositions described herein. In embodiments, the kit provides instructions for use. The instructions for use can pertain to any of the methods described herein. In related embodiments, the instructions pertain to using the attenuated vector or pharmaceutical composition(s) for treating or preventing infection by a pathogenic agent (e.g., *chlamydia*). Kits according to this aspect of the invention may comprise a carrier means, such as a box, carton, tube or the like, having in close confinement therein one or more container means, such as vials, tubes, ampules, bottles and the like. In embodiments, the kit provides a notice in the form prescribed by a governmental agency regulating the manufacture, use, or sale of pharmaceuticals or biological products, which notice reflects approval by the agency of manufacture, use or sale of the kit and the components therein for human administration.

EXAMPLES

It should be appreciated that the invention should not be construed to be limited to the examples that are now described; rather, the invention should be construed to include any and all applications provided herein and all equivalent variations within the skill of the ordinary artisan.

Example 1

Chlamydial Shuttle Vector and Open Reading Frame Mutagenesis

The shuttle vector pBRCT (FIG. 1A), similar to the previously described pBR325::L2 (Wang, Y. et al., *PLoS Pathog* 7:e1002258 (2011)), was constructed. The difference between these two chimeric plasmids is that pBRCT retains all plasmid ORFs intact while pBR325::L2 has a disrupted pgp7. A PCR-based deletion-mutagenesis approach was adopted to generate specific deletions in each of the eight chlamydial ORFs (FIG. 1B). To knockout ORFs without introducing potential polar effects on neighboring genes, both the transcriptional start site (TSS) and ~100 bp upstream (5') of the TSS was conserved for each ORF. Some discrepancies exist in the reported TSSs identified by two different groups (see Table 1 below) (Albrecht, M. et al., *Nucleic Acids Res.* 38:868-877 (2010); and Ricci, S. et al., *Gene* 154:93-98 (1995)). Those TSSs located the farthest upstream from the start were used for primer design if conflicting TSSs were reported. Another strategy employed was to introduce frame-shift mutations in those partially deleted ORFs with otherwise conserved 5' ends (i.e., pgp1-2, -6 and -8). The noncoding RNA (ncRNA), antisense to 3' end of pgp8 (Ricci, S. et al., *Mol. Gen. Genet.* 237:318-326 (1993)) was left intact in the pgp8 knockout. Conversely, another noncoding RNA (pL2-sRNA1) antisense to the pgp5 gene (Albrecht, M. et al., *Nucleic Acids Res.* 38:868-877 (2010)) was co-deleted in the pgp5 knockout.

TABLE 1

Comparison of different transcriptional start sites of plasmid ORFs and deletion positions of eight individual plasmid-ORF knockouts

| Plasmid ORFs (1) | TSSs identified by Albrecht et al. (2) | TSSs identified by Ricci et al. (3) | ORF position | Deleted Region |
|---|---|---|---|---|
| pgp1 | 4140* | 4107, 4108 | 4068-2713 | 3827-2804 |
| pgp2 | 2703* | 4107, 4108 | 2719-1655 | 2603-1712 |
| pgp3 | — | 1611* | 1593-799 | 1593-857 |
| pgp4 | 756 | 758* | 729-421 | 729-577 |
| pgp5 | 476 | 478* | 330-7098 | 330-7218 |
| pgp6 | 7117* | — | 7101-6358 | 6997-6383 |
| pgp7 | 6157* | 6157 | 6126-5344 | 6126-5344 |
| pgp8 | 3926*, 4108 | 4079 | 4167-5159 | 4241-4668 |

Nucleic acid position is indicated according to plasmid pL2 (GenBank No. NC_010285).
*TSSs adopted for primer design in this paper.
(1) Lusher, T. et al., *Microbiology* 143: 1847-1854 (1997).
(2) Albrecht, M. et al., *Nucleic Acids Res.* 38: 868-877 (2010),
(3) Ricci, S. et al., *Gene* 154: 93-98 (1995).

Figure 1D:
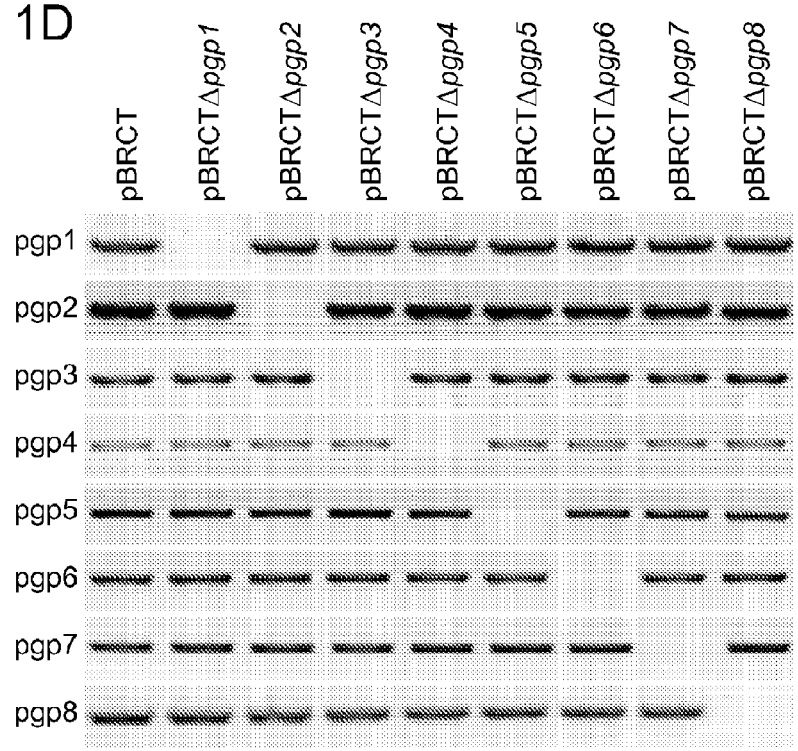

The desired deletion endpoints were identified for each ORF (Table 1), primers with a unique NcoI site at their 5' ends (Table 2) flanking the desired deletion region were designed, and PCR reactions were performed with pBRCT using each primer pair as described below (FIG. 1C). After digestion with DpnI and NcoI, purified PCR products were ligated and transformed into E. coli TOP10. Positive transformants were screened by PCR with primer pairs specific for each ORF (FIG. 1D) and the desired construction was confirmed by sequencing. The plasmid ORF knockout vectors are referred to as follows: pBRCTΔpgp1, -Δpgp2, -Δpgp3, -Δpgp4, -Δpgp5, -Δpgp6, -Δpgp7 and -Δpgp8. Vectors pgp3-5 and -7 are completely deleted while the other four ORFs contain internal deletions.

TABLE 2

Oligonucleotides used in the study

| Oligo Name | Sequence (5' to 3') | 5' Modification | 3' Modification | Application |
|---|---|---|---|---|
| JHC389 | GGGGGGGGGAAAAACGGCCGATTGTGATATAATTAAAATTATATTCATATTCTGTTGCC | NONE | NONE | pL2 amplification |
| JHC390 | GGGGGGGGGAAAAAGTCGACATTGGGGGTGTTTGTACTAGAGGACTTACCTCTTCCCCA | NONE | NONE | pL2 amplification |
| JHC235 | AATAGACCGGCCTCTAGCGCTGCG | NONE | NONE | pBRCT correction |
| JHC398 | CCGCATCCAAACCAATTGTAATAGAAGC | NONE | NONE | pBRCT correction |
| JHC399 | AATGAGTACAATGAAAATCCATTGCG | NONE | NONE | pBRCT correction |
| JHC400 | GAACAAGAATCTATTAATTAATAGC | NONE | NONE | pBRCT correction |
| PGP1A | TACCATGGTGGGAAAAATAGACATGGATCG | NONE | NONE | pgp1 knockout |
| PGP1B | TACCATGGCCATATCTTTGATACGACGCCG | NONE | NONE | pgp1 knockout |
| PGP2A | TACCATGGATAACTAAGAAATCTAAAGAACAAATG | NONE | NONE | pgp2 knockout |
| PGP2B | TACCATGGCCATTTTGAGCCAATTTGGGA | NONE | NONE | pgp2 knockout |
| PGP3A | TACCATGGAATAACAAATACTTCTAATGTATCTTTTT | NONE | NONE | pgp3 knockout |
| PGP3B | TACCATGGTTTAAAACTCTTTTTTATTTTGAGCTTTAA | NONE | NONE | pgp3 knockout |
| PGP4A | TACCATGGCTAATTCTAGGACTGCTTCAAC | NONE | NONE | pgp4 knockout |
| PGP4B | TACCATGGAACAAACCCCGTAATTCGAAC | NONE | NONE | pgp4 knockout |
| PGP5A | TACCATGGTCTGTAGCTAATGTCTATCCAAA | NONE | NONE | pgp5 knockout |
| PGP5B | TACCATGGGTTTAGAGAAAGTGTTGTTTTCC | NONE | NONE | pgp5 knockout |
| PGP6A | TACCATGGTGAACTTTTTAAGCAAAAGAGCTGA | NONE | NONE | pgp6 knockout |
| PGP6B | TACCATGGGCTGAGAATAGTTCAATGGAAGG | NONE | NONE | pgp6 knockout |
| PGP7A | TACCATGGTTCATTTAAAGCAAATAGGATTAAAAG | NONE | NONE | pgp7 knockout |
| PGP7B | TACCATGGTTTCTTAACCAAAGCTATTCAAAATC | NONE | NONE | pgp7 knockout |
| PGP8A | TACCATGGAAAACTTCCTGATAAGACTTTTCG | NONE | NONE | pgp8 knockout |
| PGP8B | TACCATGGAGCTAAAAAAAATCAATGCCCG | NONE | NONE | pgp8 knockout |

TABLE 2-continued

Oligonucleotides used in the study

| Oligo Name | Sequence (5' to 3') | 5' Modification | 3' Modification | Application |
|---|---|---|---|---|
| PGP1F | ATGAAAACTCGTTCCGAAATAGAAA | NONE | NONE | pgp1 detection |
| PGP1R | TTACCATACTTTTTTAATAGCGGAGAA | NONE | NONE | pgp1 detection |
| PGP2F | ATGGTAAATTATAGTAACTGCCACTTCAT | NONE | NONE | pgp2 detection |
| PGP2R | TTAATTAATAGATTCTTGTTCTAATTGTTC | NONE | NONE | pgp2 detection |
| PGP3F | ATGGGAAATTCTGGTTTTTATTTGTAT | NONE | NONE | pgp3 detection |
| PGP3R | TTAAGCGTTTGTTTGAGGTATTACCT | NONE | NONE | pgp3 detection |
| PGP4F | ATGCAAAATAAAAGCAAAGTGAGGG | NONE | NONE | pgp4 detection |
| PGP4R | CTATTCAGCCTTGGAAAACATGTCT | NONE | NONE | pgp4 detection |
| PGP5F | GTGGGATGCAACTTGGCCCA | NONE | NONE | pgp5 detection |
| PGP5R | TCACGTTGTCCTCTGAGAGTAATCTCG | NONE | NONE | pgp5 detection |
| PGP6F | GTGAACAAACTAAAAAAAGAAGCGAAT | NONE | NONE | pgp6 detection |
| PGP6R | TCAGCTCTTTTGCTTAAAAAGTTCA | NONE | NONE | pgp6 detection |
| PGP7F | ATGGGCTCGATGGCTTTCCAT | NONE | NONE | pgp7 detection |
| PGP7R | TCAAAGCGCTTGCACGAAGTACT | NONE | NONE | pgp7 detection |
| PGP8F | ATGGGTAAAGGGATTTTATCTTTGC | NONE | NONE | pgp8 detection |
| PGP8R | CTATATTAGAGCCATCTTCTTTGAAGC | NONE | NONE | pgp8 detection |
| 1334RRMH374F | GATGCTACAGCCCCAACTGATC | NONE | NONE | CTL0305 qPCR |
| 1420RRMH374R | TGCACTCCCAACTACAGTTTTCC | NONE | NONE | CTL0305 qPCR |
| 1357RRMH374FAM | AGAGCCTTCACCAGCATTTTCCGTGGT | FAM | BHQ1 | CTL0305 qPCR |
| 715RRMH298F | CCTGACGGACCTTTTTCTTCTTC | NONE | NONE | CTL0397 qPCR |
| 822RRMH298R | ATATAAAGTGGACAAGGCGGACTT | NONE | NONE | CTL0397 qPCR |
| 793RRMH298FAMRC | CATAGTCTCCGCCCTTGTAACGCACCTCTA | FAM | BHQ1 | CTL0397 qPCR |
| 97RRMH299F | CATTGCGCATCCATAAGTTTTG | NONE | NONE | CTL0398 qPCR |
| U10RRMH299R | GGAGGATAACATGAAGAAACCAGTATTT | NONE | NONE | CTL0398 qPCR |

TABLE 2-continued

| Oligonucleotides used in the study | | | | |
|---|---|---|---|---|
| Oligo Name | Sequence (5' to 3') | 5' Modification | 3' Modification | Application |
| 66RRMH299FAM | CCCCGTTCCTTCTTCTGTACTTATCCCAGG | FAM | BHQ1 | CTL0398 qPCR |
| 363RRMH300F | TAAGAATGGAGAGCCTAAAATAAGTATGC | NONE | NONE | CTL0399 qPCR |
| 441RRMH300R | CCAGCCTCTAGTATCTCCAGATCCT | NONE | NONE | CTL0399 qPCR |
| 395RRMH300FAM | CAGCGCTATCCGGAGGCCACG | FAM | BHQ1 | CTL0399 qPCR |
| 38RRMH1106F | GCGTTATGTGTTTAACTTGTAGTTTGCT | NONE | NONE | CTL0638 qPCR |
| 149RRMH1106R | TCTATCAGCGTCGTAAGAAAAGCTT | NONE | NONE | CTL0638 qPCR |
| 117RRMH1106FAMRC | CGCCTCATCAGCATATTCAGCTCTTCCTTT | FAM | BHQ1 | CTL0638 qPCR |
| glgA-1406RRMH150F | AAATATTTATTGGCGGCAGTTTCT | NONE | NONE | glgA qPCR |
| glgA-1298RRMH150R | TTTCGGAAGCAGTGACAACCT | NONE | NONE | glgA qPCR |
| glgA-1320RRMH150FAMRC | CCGTACCAACCACGACAAGTGGCAA | FAM | BHQ1 | glgA qPCR |
| rpoB-2218RRMH804F | CGTTTTTACCAAGAGCCAATTCC | NONE | NONE | rpoB qPCR |
| rpoB-2125RRMH804R | CCTTTGTGTTCTGTGGGAGATGT | NONE | NONE | rpoB qPCR |
| rpoB-2171RRMH804CFGRC | CGGATGGCCCAGCAACCGATAA | CalFluorGold540 | BHQ1 | rpoB VCR |
| gyrA-1682RRMO1214F | TCACCAACTTCGGTCAGTGTTACT | NONE | NONE | gyrA qPCR |
| gyrA-1758RRMO1214R | AGGTTTCCCTTTTGCTTTACGTT | NONE | NONE | gyrA qPCR |
| gyrA-1734RRMO1214CFGRC | CCTTCAGGAAGCCGCCATACTTTAAC | CalFluorGold540 | BHQ1 | gyrA qPCR |
| lpdA-812RRMH479F | CAGAAAATATTGGCTTGGATAAAGCT | NONE | NONE | lpdA qPCR |
| lpdA-901RRMH479R | TAGGTACGTTTGTGCGCATTGT | NONE | NONE | lpdA qPCR |
| lpdA-852RRMH479CFG | TGAACGCGGAGTCATCCCTACCGAT | CalFluorGold540 | BHQ1 | lpdA qPCR |
| fusA-1525RRMH125F | GGACAATATGCTCACGTTTGCTT | NONE | NONE | fusA qPCR |
| fusA-1615RRMH125R | GAATTACCCCTCCGACGATCT | NONE | NONE | fusA qPCR |
| fusA-1582RRMH125CFGRC | CGTTTCCTTTTCCAGGTTCATTTGGCTC | CalFluorGold540 | BHQ1 | fusA VCR |

Example 2 pgp1, -2, -6 and -8 are Essential for Plasmid Maintenance

Transformations of a naturally occurring plasmid-less *C. trachomatis* strain L2R with pBRCT and its derivatives were performed. Stable transformants of pBRCT, pBRCTΔpgp3, -Δpgp4, -Δpgp5, and -Δpgp7, referred to as L2Rp+, L2RpΔpgp3, L2RpΔpgp4, L2RpΔpgp5, and L2RpΔpgp7, respectively, were isolated and plaque cloned. Transformation with the other four deletion vectors yielded either transient/unstable transformants (pBRCTΔpgp6 and -Δpgp8) or no transformants (pBRCTΔpgp1 and -Δpgp2), suggesting pgp1, -2, -6 and -8 are essential genes for plasmid maintenance. Transformation results are summarized in Table 3.

TABLE 3

Growth characteristics of *C. trachomatis* L2R transformed with pBRCT and eight pBRCT deletion derivatives

| Vectors | Penicillin-resistant transformants* | Phenotypes** |
|---|---|---|
| pBRCT | + | S |
| pBRCTΔpgp1 | − | na |
| pBRCTΔpgp2 | − | na |
| pBRCTΔpgp3 | + | S |
| pBRCTΔpgp4 | + | S |
| pBRCTΔpgp5 | + | S |
| pBRCTΔpgp6 | + | T |
| pBRCTΔpgp7 | + | S |
| pBRCTΔpgp8 | + | U |

*Presence/absence of penicillin-resistant transformants is indicated by + or −.

**Stability of penicillin-resistance is indicted by S (stable), U (unstable), T (transient) or na (not applicable). Results represent a summary from 3 independent experiments.

Pgp1 is likely a replicative helicase as it shares homology with DnaB of E. coli. The negative transformation results suggest that Pgp2 is also involved in plasmid replication. The ori for the C. trachomatis plasmid is in a region that contains four 22-bp tandem repeats (iteron), which resembles those of E. coli plasmids pSC101, mini-F and RK2 (Tam, J. E. et al., Plasmid 27(3):231-236 (1992)). These E. coli plasmids' replication and copy numbers are controlled by interactions of iterons and cognate Rep proteins (Chattoraj, D. K., Mol. Microbiol. 37:467-476 (2000)). Therefore, Pgp2 may be a Rep protein, and the chlamydial plasmids' replication and copy number are controlled by Pgp2 binding to the ori.

Maintenance of plasmids having less than 10 copies/cell requires an active partitioning system (Gerdes, K. et al., Mol. Microbiol. 37:455-466 (2000)). The pgp8 transformants were consistently a mixture of penicillin resistant and sensitive derivatives whereas pgp6 mutants had transient penicillin resistance suggesting that Pgp6 and Pgp8 are plasmid partitioning proteins. pgp7 is the only gene containing significant sequence variations between the chlamydial plasmids (Thomas, N. S. et al., Microbiology 143:1847-1854 (1997); and Seth-Smith, H. M. et al., BMC Genomics 10:239 (2009)). Consistent with a previous report by Wang et al., PLoS Pathog. 7:e1002258 (2011), it was found that pgp7 is not essential for plasmid maintenance. Based on its 32-35% amino acid identity with Pgp8 (Thomas, N. S. et al., Microbiology 143:1847-1854 (1997)), it is likely that Pgp7 functions, but is not essential for plasmid partitioning. Plasmid partitioning may be regulated by ncRNAs (Albrecht, M. et al., Nucleic Acids Res. 38:868-877 (2010)) antisense to pgp8 mRNA. Identification of essential genes for plasmid maintenance supports the future development of custom shuttle vectors that take advantage of these biological attributes.

Example 3 pgp4 Null Mutants Exhibit L2R-like In Vitro Phenotypes

Figures 2A, 2B, 2C, 2D:
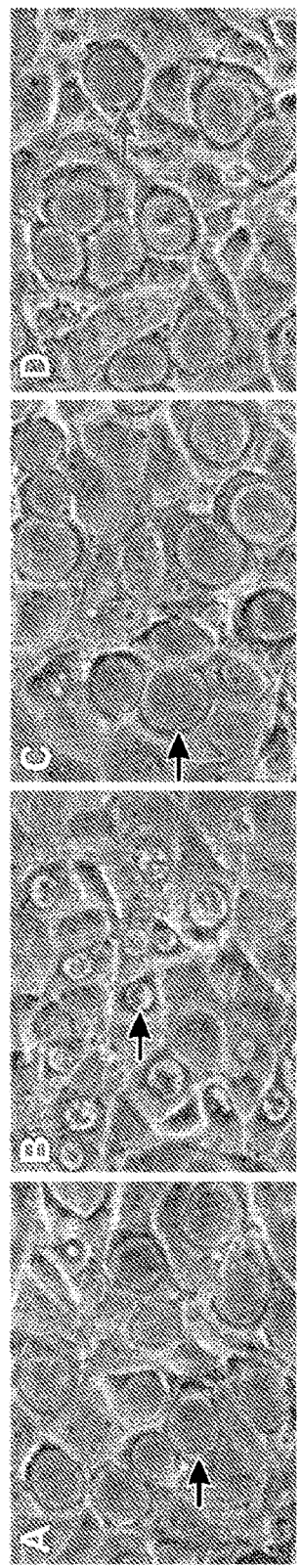

The identity of the gene(s) connected with two distinguishing phenotypes between L2 and L2R: inclusion morphology and glycogen accumulation (Carlson, J. H. et al., Infect. Immun. 76:2273-2283 (2008)), were sought to be identified. Of the four stable mutants, pgp4 mutants exhibit L2R-like late infection inclusion morphology with a central dense amorphous structure surrounded by empty space. Conversely, all other deletion mutants show L2-like inclusion morphology with uniform density throughout the inclusion (FIGS. 2A-2G). Iodine staining demonstrated that mature inclusions of pgp4 null mutants also lack glycogen accumulation (FIGS. 2A'-G'). The association of both late infection inclusion morphology and lack of glycogen accumulation indicate that these two in vitro phenotypes are related.

For Pgp4 dependent glycogen accumulation to relate to the pathogenicity of in vivo chlamydial infection, glycogen could serve as an essential carbon source within a nutritionally limiting inflammatory environment. Such an environment would be an advantage to chlamydial survival in mucosal tissues. Alternatively, chlamydial glycogen may be a TLR2 ligand or immune modulator as has been shown for enzymatically synthesized glycogen (Kakutani, R. et al., Glycobiology 22:146-159 (2012)) and Mycobacteria tuberculosis glucans (Geurtsen, J. et al., J. Immunol. 183:5221-5231 (2009)), respectively. Consistent with this reasoning, plasmid dependent TLR2 activation has been shown to be associated with both the early production of inflammatory mediators and development of chronic oviduct pathology in the murine model of C. muridarum (O'Connell, C. M. et al., J. Immunol. 179:4027-4034 (2007)).

Example 4

Pgp4 is a Transcriptional Regulator of Multiple Chromosomal Genes

Figure 3A:
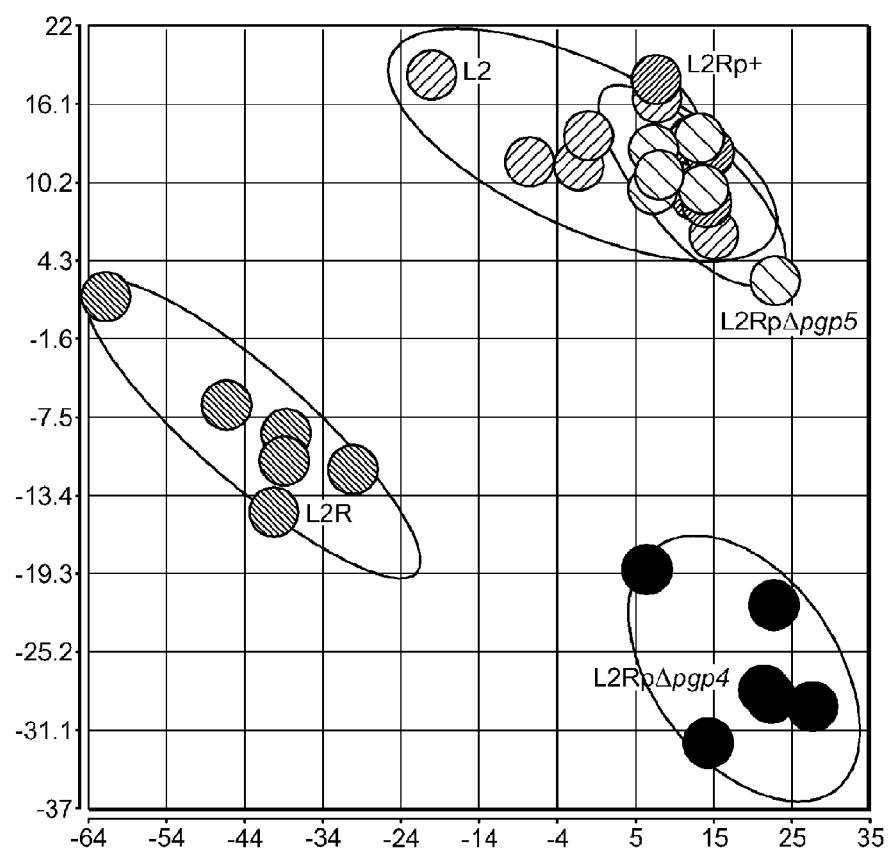
FIGS. 3A and 3B show the results from microarray analyses identifying Pgp4 as a transcriptional regulator of chromosomal genes.

The transcriptional profiles of L2, L2R, L2Rp+, L2RpΔpgp4, and L2RpΔpgp5 infected McCoy cells were compared by microarray analyses. L2RpΔpgp5 was included as pgp5 and its antisense ncRNA, one of the most abundant RNAs in L2 (Albrecht, M. et al., Nucleic Acids Res. 38:868-877 (2010)), could also play a transcriptional regulatory role. Microarray data were collected from six independent culture replicates representing each of the infection types. Principal component analysis demonstrated tight clustering of replicates within each infection type and good distance between replicate groups generating three distinct clusters composed of (1) L2, L2Rp+ and L2RpΔpgp5, (2) L2R, and (3) L2RpΔpgp4 (FIG. 3A).

Figure 3B:
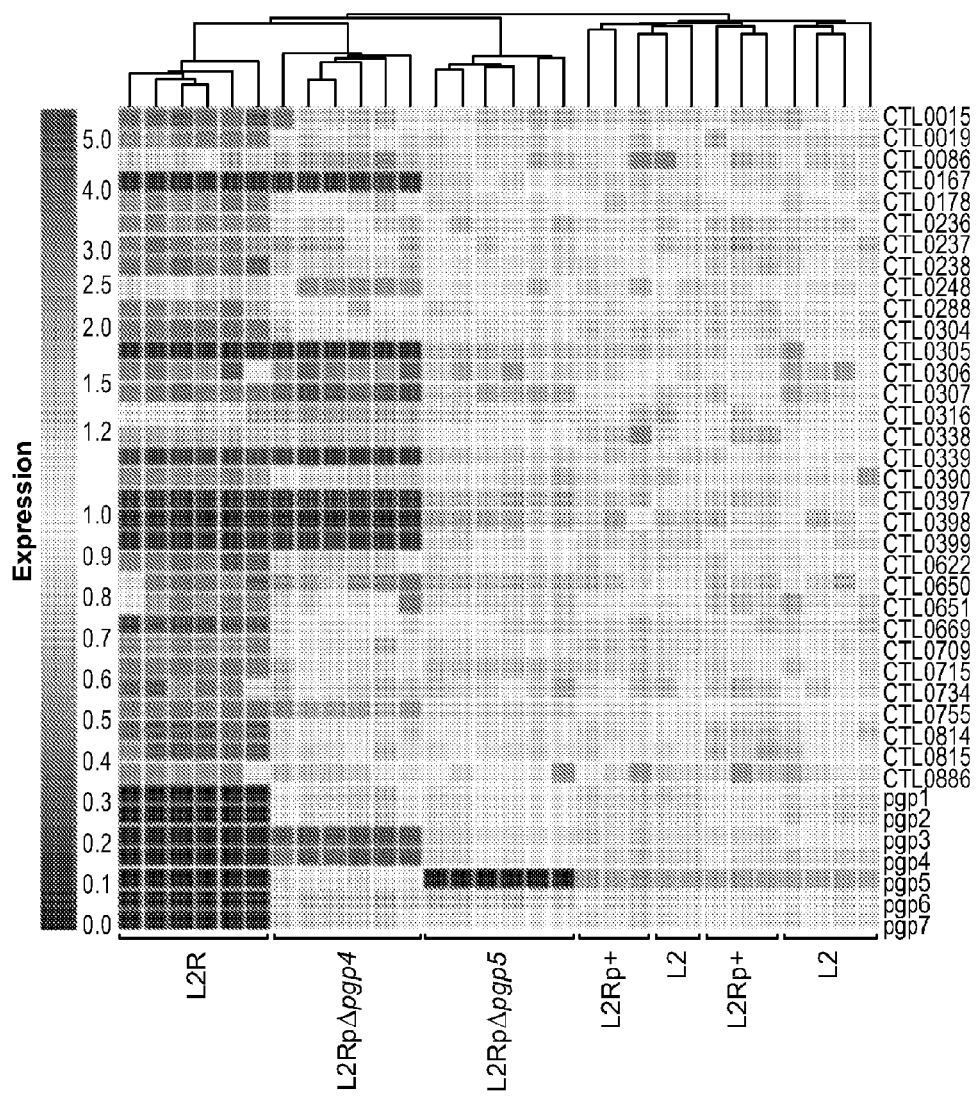

Hierarchical clustering analysis based on differentially expressed genes was then performed to compare the gene expression patterns between the five infection groups (FIG. 3B). No significant transcriptional differences were observed between the L2 vs L2Rp+ and L2Rp+ vs L2RpΔpgp5 comparisons, indicating that pBRCT complemented the plasmid at the transcript level. This also demonstrated that neither Pgp5 nor its antisense ncRNA have a role in chromosomal gene expression. Differentially expressed genes were observed in the L2 vs L2R and L2Rp+ vs L2RpΔpgp4 pairwise comparisons. Overall, 41 transcripts exhibiting a ≥2-fold differential were identified (Table 4), 39 of which passed all test criteria. Clustering analysis of these 39 genes generated a hierarchical tree showing a strong correlation between L2RpΔpgp4 and L2R. Noticeably, the 6 genes showing the greatest differential in expression (>5-fold change) were consistently found in both L2 vs L2R, and L2Rp+ vs L2RpΔpgp4 comparisons.

TABLE 4

Genes demonstrating a twofold or greater transcript differential by microarray analysis in pairwise comparisons

| L2/434 CTL# | Gene abbreviation | Fold change | |
|---|---|---|---|
| | | L2RpΔpgp4 versus L2Rp+ | L2R versus L2 |
| pgp1 | | −1.21 | −1666.80 |
| pgp2 | | −1.11 | −340.04 |
| pgp3 | | −4.03 | −282.78 |
| pgp4 | | −3.65 | −65.26 |
| pgp5 | | −1.83 | −1890.48 |
| pgp6 | | −1.23 | −205.90 |
| pgp7 | | −1.18 | −607.15 |
| pgp8 | | 1.40 | −7.11 |
| 015 | hypothetical | −1.66 | −3.17 |
| 019 | hypothetical | 1.24 | −2.21 |
| 071 | hypothetical | −2.83 | −3.69 |
| 086 | fliI | 2.00 | 1.18 |
| 167 | glgA | −8.57 | −18.32 |
| 178 | hypothetical | −1.14 | −2.36 |
| 236 | copB2 | −1.19 | −2.38 |
| 237 | lcrH2 | −1.44 | −2.82 |
| 238 | hypothetical | −1.31 | −2.97 |
| 248 | pmpE | 2.69 | 1.03 |
| 288 | recD | −1.20 | −2.14 |

TABLE 4-continued

Genes demonstrating a twofold or greater transcript differential by microarray analysis in pairwise comparisons

| L2/434 CTL# | Gene abbreviation | Fold change L2RpΔpgp4 versus L2Rp+ | L2R versus L2 |
|---|---|---|---|
| 304 | hypothetical | −1.21 | −2.84 |
| 305 | hypothetical | −18.47 | −15.93 |
| 306 | hypothetical | −2.03 | −2.99 |
| 307 | hypothetical | −3.38 | −3.32 |
| 316 | flhA | 2.13 | −1.16 |
| 338 | hypothetical | 2.19 | 1.58 |
| 339 | pld | −7.13 | −5.92 |
| 390 | hypothetical | 1.20 | −2.12 |
| 397 | hypothetical | −13.25 | −17.55 |
| 398 | hypothetical | −22.71 | −25.41 |
| 399 | hypothetical | −6.61 | −10.57 |
| 622 | aroC | 1.32 | −2.87 |
| 650 | hrcA | −2.04 | −1.99 |
| 651 | grpE | −1.32 | −2.07 |
| 669 | pmpA | −1.11 | −4.32 |
| 709 | hypothetical | −1.17 | −2.21 |
| 715 | murA | −1.12 | −2.53 |
| 734 | hypothetical | −1.04 | −2.42 |
| 755 | sohB | −1.71 | −2.59 |
| 814 | hypothetical | −1.19 | −3.74 |
| 815 | hypothetical | −1.05 | −3.42 |
| 886 | CHLPN | 1.93 | 2.27 |

Figure 4:
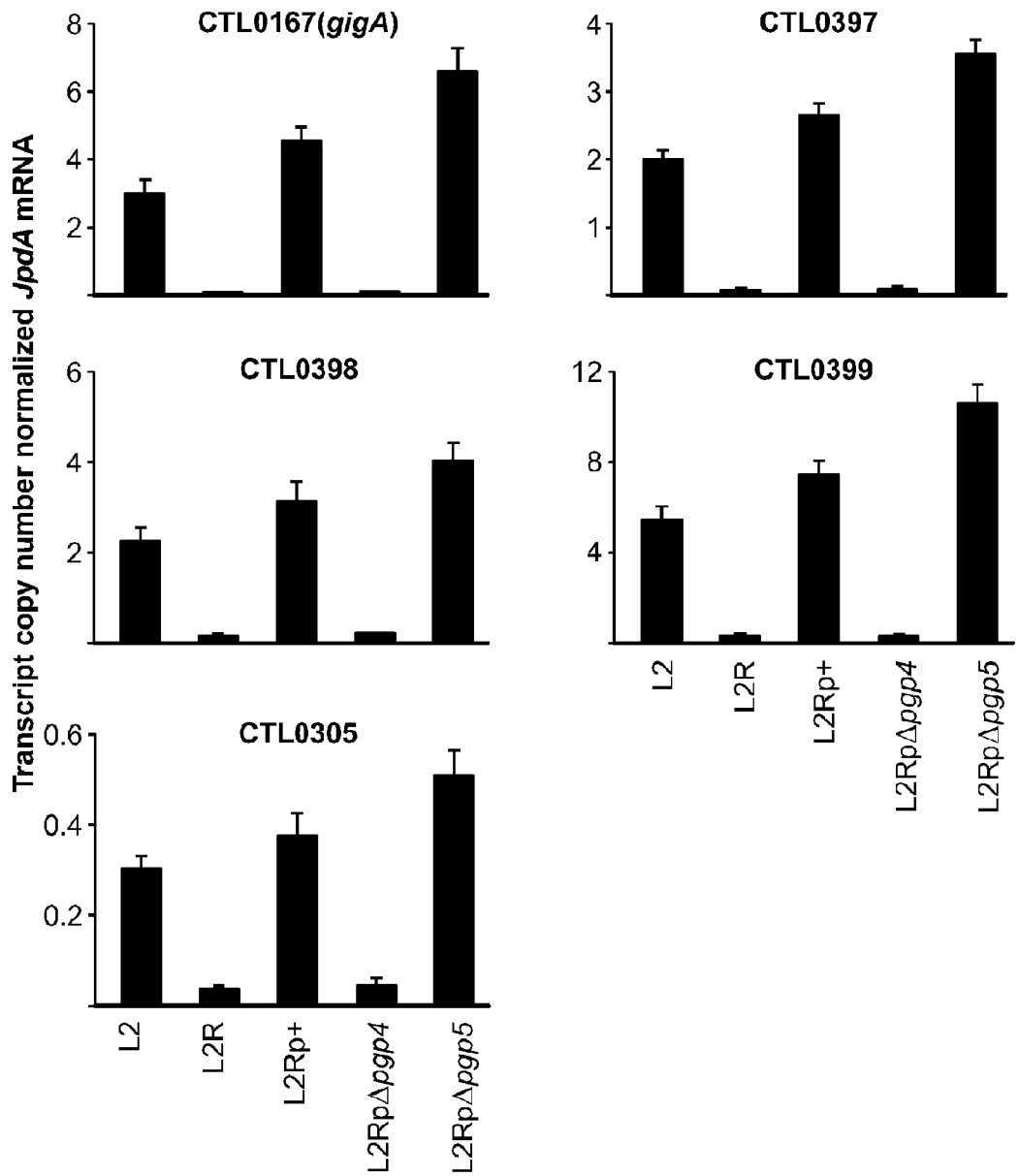
FIG. 4 are plots showing validation of the microarray data by quantitative RT-PCR. The results indicate that five chromosomal genes, including glgA, CTL0305, and CTL0397-CTL0399 significantly ($p<0.01$), were differentially expressed in L2R vs L2, and L2pΔpgp4 vs L2Rp+ comparisons. Transcript copy numbers derived from three replicates were normalized to lpdA mRNA.

To verify the microarray results, the same RNA samples were used to examine the expression of five transcripts (CTL0305, CTL0397-0399, and glgA) by qRT-PCR. The target transcripts were normalized against a constitutively expressed transcript (lpdA). Significant changes were in transcript levels of all five genes in L2 vs L2R, and L2Rp+ vs L2RpΔpgp4 (FIG. 4), confirming the microarray results. Collectively, the microarray and qRT-PCR data show that pgp4 is the only plasmid gene involved in transcriptional regulation of chromosomal genes.

Example 5

Enhancement of Attenuating Mutations

Figure 31:
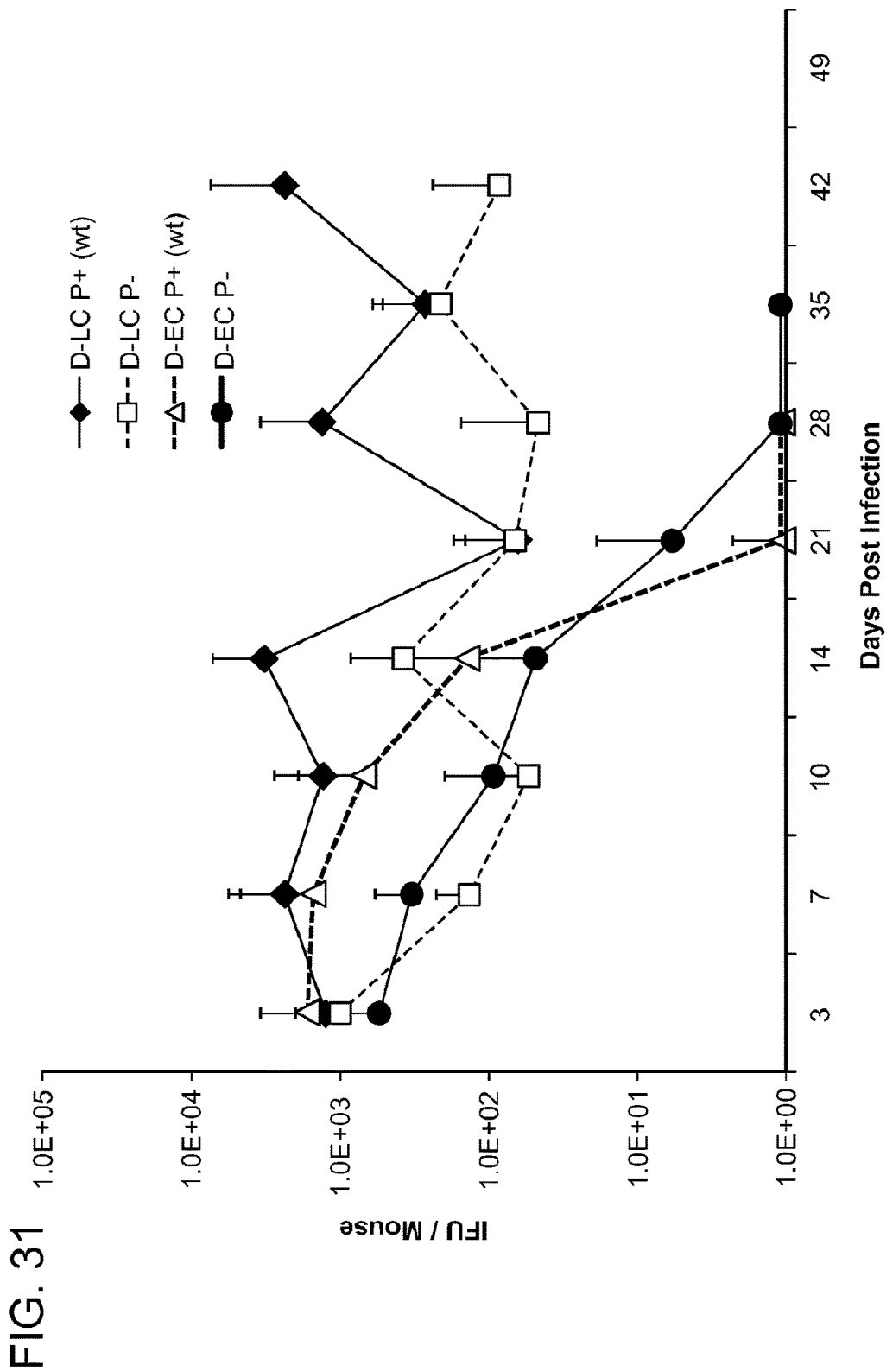
FIG. 31 show the infection kinetics of four *C. trachomatis* serovar D strains with various deficiencies in plasmid and the chromosomal gene CT135. C3H/HeJ mice were infected with $10^5$ inclusion forming units (IFU) with four isogenic clones of the parental strain D/UW-3/CX, each differing by plasmid content, disruption of the gene CT135, or a combination of the two. CT135 "intact" clone (D-LC P+) and CT135 "disrupted" clone (D-EC P+) are depicted by diamonds and triangles, respectively. Plasmidless isolates of D-LC P− and D-EC P− are depicted by squares and circles, respectively. The course of infection was monitored by culturing chlamydiae from cervical vaginal swabs. The findings of six to eight mice per group with mean IFU recovery are shown.

To determine whether modifications or absence of the plasmid can be effectively used in combination with other mutations (e.g., chromosomal mutations), the infectivity of various mutant strains of C. trachomatis serovar D (a genital pathogen) were compared in C3H/HeJ mice. Specifically, C3H/HeJ mice were infected with $10^5$ inclusion forming units (IFU) with four isogenic clones of the parental strain D/UW-3/CX, each differing by plasmid content, disruption of the gene CT135, or a combination of the two. CT135 "intact" clone (D-LC P+) and CT135 "disrupted" clone (D-EC P+) are depicted by diamonds and triangles respectively. Plasmidless isolates of D-LC P− and D-EC P− are depicted by squares and circles, respectively. The course of infection was monitored by culturing chlamydiae from cervical vaginal swabs, and the findings of six to eight mice per group with mean IFU recovery are shown in FIG. 31. The results indicate that serovar D P− with a CT135 null mutation is much more attenuated than its isogenic strain, which only lacks the plasmid. As such, plasmid curing (i.e., removal of the plasmid) or use of an attenuated plasmid (e.g., a plasmid having a deletion in a major virulence gene as described herein) in combination with other mutations (e.g., chromosomal mutations) is an effective strategy to further attenuating chlamydial strains.

As described in detail herein, deletion mutagenesis and chlamydial transformation were performed to define the function of individual C. trachomatis plasmid genes. Two plasmid ORF clusters pgp1-2 and pgp6-8 were found to function in plasmid replication and partitioning, respectively. The pgp3-5 cluster therefore represents the primary virulence genes that function in chlamydial pathogenicity and likely independently account for the pathogens profound in vivo infection attenuation characteristics. In addition, pgp4 is the gene that regulates the transcription of multiple chromosomal genes including glgA, CTL0305, and CTL0397-399.

These findings have important practical applications for the design of novel live-attenuated vaccines that are capable of targeting immunization of mucosal surfaces. For example, a chlamydial plasmid shuttle vector with deleted major virulence genes (e.g., pgp3-5) can be used to express multiple C. trachomatis serovariable protective antigens such as the major outer membrane protein in a single transformed chlamydial strain. Conversely, the attenuated plasmid shuttle vector could be employed to express non-chlamydial genes that represent important vaccine targets for other mucosal pathogens.

The results reported herein were obtained using the following methods and materials.

Cell Culture and *Chlamydia* Strains

McCoy cells were grown at 37° C. with 5% $CO_2$ in high glucose containing DMEM (Mediatech, Inc., Herndon, Va.) supplemented with 10% fetal bovine serum. C. trachomatis L2 (L2/LGV-434/Bu) and L2R [L25667R]) (Peterson, E. M. et al., *Plasmid* 23:144-148 (1990)) EBs were purified from infected HeLa 229 cells by Renografin density gradient centrifugation as previously described (Caldwell, H. D. et al., *J Immunol* 115:963-968 (1975)). Strain L2(25667R) was originally isolated by Schachter, J. et al., *Br Med Bull* 39:151-154 (1983), and kindly provided by Luis de la Maza (University of California, Irvine, Calif.).

Construction of pBRCT

Plasmid pL2 was purified from DG purified L2 EBs using a QIAquick Plasmid Mini Prep kit (Qiagen, Hercules, Calif.). pL2 was partially digested with SspI and amplified with primers JHC389 and JHC390 (Table S2) using an Expand Long Range PCR amplification kit (Roche, Indianapolis, Ind.). pBR322 and the PCR product were double digested with EagI and SalI and the desired products gel purified using a QIAEX II kit (Qiagen, Hercules, Calif.). The restriction digested PCR product was ligated into the pBR322 backbone and transformed into *E. Coli* TOP10 (Invitrogen, Carlsbad, Calif.). Clone pBRCT #5 was sequenced and 6 mutations were identified in the pL2 portion. All six mutations were replaced using three separately cloned fragments of the chlamydial plasmid, specifically the EagI/BglII, BglII/MfeI, and MfeI/SalI fragments. Sequence analysis of the final pBRCT clone identified a SNP from that of the predicted sequence. It is a C to T transition located 190 bp downstream of the EagI site in the 3' truncated portion of the pBR322 tet ORF.

Generation of pBRCT Deletion Derivatives

Deletion derivatives of pBRCT were constructed using a modified PCR based approach (Pérez-Pinera, P. et al., *Electronic J Biotechnol* 9:604-609 (2006)). Primer pairs for knocking out each individual or combined ORFs of pL2 were as shown in Table 2. Briefly, PCR amplifications were performed in 100 μl reaction volumes containing 10 ng pBRCT, 200 nM of each dNTP, 0.1 nM of each primer, 2 U Phusion High Fidelity DNA Polymerase (New England Biolabs, Ipswich, Mass.) and 20 μl Phusion HF buffer. PCR conditions were as follows: initial denaturation at 98° C. for 1 min, followed by 25 cycles of amplification at 98° C. for 10 s, 60° C. for 15 s, and 72° C. for 3.5 min, followed by final extension at 72° C. for 10 min. PCR products were purified by a QIAquick PCR Purification Kit (Qiagen, Hercules, Calif.) and doubly digested with DpnI (to remove template DNA) and NcoI-HF (New England Biolabs, Ipswich, Mass.). Digested products were repurified using the QIAquick PCR Purification Kit. The resulting digested PCR products were ligated using Quick T4 DNA Ligase (New England Biolabs, Ipswich, Mass.) and transformed into *E. Coli* TOP10. Clones were screened for plasmids containing all the pL2 ORFs but lacking the deleted region by PCR. The resulting plasmids were purified using a Plasmid Maxi Kit (Qiagen, Hercules, Calif.) and subjected to sequencing analysis and transformation.

Transformation of *C. trachomatis* L2R

The initial transformation experiments with pBRCT and its nine derivatives followed the procedures described by Wang, Y. et al., *PLoS Pathog* 7:e1002258 (2011). Repeat transformations using pBRCT and the pgp1-2, -6, -8 knockout plasmids were performed following a modified transformation method. Our modified transformation procedure is briefly described below. 10 μl EBs ($1\times10^8$ IFU) and 6 μl plasmid DNA (6 μg) were added to 200 μl $CaCl_2$ buffer (Wang, Y. et al., *PLoS Pathog* 7:e1002258 (2011)) and the mixture was incubated for 30 min at room temperature after gently pipetting 10 times. The plasmid-EB mix was added to 12 ml ice cold sucrose phosphate glutamate buffer and gently mixed. The mixture was then evenly added to McCoy cells grown in one 6-well plate ($1.5\times10^6$ cells per well). After centrifugation at 545 g for 1 h, the inocula were removed and 3 ml of media without cycloheximide or penicillin was added to each well. The cells were incubated at 37° C. in 5% $CO_2$ for 40 h. The cultures were then passaged with penicillin selection as described by Wang, Y. et al., *PLoS Pathog* 7:e1002258 (2011).

Chlamydial Culture and Purification

All stable *C. trachomatis* transformants were plaque purified as described previously by Matsumoto, A. et al., *J Clin Microbiol* 36:3013-3019 (1998). The plaque purified chlamydiae plasmids were resequenced to confirm the expected sequences of each vector and then propagated in McCoy cells to make stock preparations. Large scale cultures of *Chlamydia* were harvested by 30% density gradient centrifugation and stored at −80° C. as previously described (Caldwell, H. D. et al., *J Immunol* 115:963-968 (1975)).

Microscopy and Glycogen Staining

Monolayers of McCoy cells grown in 24-well plates were infected with *C. trachomatis* strains at an MOI of 0.3. Infected cultures were incubated at 37° C. for 40 h. Phase contrast images were captured at ×200 magnification using a Nikon eclipse TS100 inverted microscope to record the inclusion morphology of *C. trachomatis* strains. The growth media were then removed and the monolayers were directly stained with 1 ml 1% Lugol's iodine solution for photomicroscopy.

Transcription Analysis

Six 6-well plates containing McCoy cells ($1.5\times10^6$ cells per well) were infected with L2, L2R, L2Rp+, L2RpΔpgp4, L2RpΔpgp5 (MOI of 1.5) or mock infected and grown for 24 h at 37° C. with 5% $CO_2$. Each infection group consisted of six replicates. The medium was removed by aspiration. RNA and genomic DNA were extracted in randomized order using Trizol LS (Life Technologies, Carlsbad, Calif.) according to manufacturer's recommendation. DNA microarray targets were prepared as described in Omsland, A. et al., *Proc Natl Acad Sci USA* 106:4430-4434 (2009). Chip hybridizations with Affymetrix GeneChip arrays (Carlson, J. H. et al., *Infect. Immun.* 76:2273-2283 (2008)) were as described previously (Virtaneva, K. et al. *Proc. Natl. Acad. Sci. USA* 102:9014-9019 (2005); and Ellison, D. W. et al., *Infect. Immun.* 76:542-550 (2008)). Microarray data were analyzed using Partek Genomics Suite software (Partek Inc.) (Carlson, J. H. et al., *Infect. Immun.* 76:2273-2283 (2008); and Li, M. et al., *Proc. Natl. Acad. Sci. USA* 104(22):9469-9474 (2007)). qRT-PCR validation was performed as previously described (Li, M. et al., *Proc. Natl. Acad. Sci. USA* 104(22):9469-9474 (2007)).

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

INCORPORATION BY REFERENCE

All patents and publications mentioned in this specification are herein incorporated by reference to the same extent as if each independent patent and publication was specifically and individually indicated to be incorporated by reference.

---

SEQUENCE LISTING (319 sequences)

SEQ ID NO: 1 - protein, 451 aa, Chlamydia trachomatis
MKTRSEIENRMQDIEYALLGKALIFEDSTEYILRQLANYEFKCSHHKNIFIVFKYLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRATFSENQNSFFDAFPTGYKDIDDKGVILAKGNFVIIAARPSIGKTALAIDMAINLAVTQQRRVGFLSLEMSAGQIVERIIANLTGISGEKLQRGDLSKEELFRVEEAGETVRESHFYICSDSQYKLNLIANQIRLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 2 - protein, 354 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLFLNVNVKSLAYILRMNRYICTRNWKKIELAIDKCIEIAIQLGWLSRRKRIEFLDSSKLSKKEILYLNKERFEEITKKSKEQMEQLEQESIN

SEQ ID NO: 3 - protein, 264 aa, Chlamydia trachomatis
MGNSGFYLYNTQNCVFADNIKVGQMTEPLKDQQIILGTTSTPVAAKMTASDGISLTVSNNPSTNASITIGLDAEKAYQLILEKLGDQILGGIADTIVDSTVQDILDKITTDPSLGLLKAFNNFPITNKIQCNGLFTPRNIETLLGGTEIGKFTVTPKSSGSMFLVSADIIASRMEGGVVLALVREGDSKPYAISYGYSSGVPNLCSLRTRIINTGLTPTTYSLRVGGLESGVVWVNALSNGNDILGITNTSNVSFLEVIPQTNA

SEQ ID NO: 4 - protein, 102 aa, Chlamydia trachomatis
MQNKSKVRDDFIKIVKDVKKDFPELDLKIRVNKEKVTFLNSPLELYHKSVSLILGLLQQIENSLGLFPDSPVLEKLEDNSLKLKKALIMLILSRKDMFSKAE

SEQ ID NO: 5 - protein, 133 aa, Chlamydia trachomatis
GLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 6 - protein, 247 aa, Chlamydia trachomatis
MNKLKKEANVFFKKNQTAASLDFKKTLPSIELFSATLNSEESQSLDQLFLSESQNYSDEEFYQEDILAVKLLTGQIKSIQKQHVLLLGEKIYNARKILSKDHFSSTTFSSWIELVFRTKSSAYNALAYYELFINLPNQTLQKEFQSIPYKSAYILAARKGDLKTKVDVIGKVCGMSNSSAIRVLDQFLPSSRNKDVRETIDKSDSEKNRQLSDFLIEILRIMCSGVSLSSYNENLLQQLFELFKQKS

SEQ ID NO: 7 - protein, 260 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFYSAMKKKLLLEYFVQAL

SEQ ID NO: 8 - protein, 330 aa, Chlamydia trachomatis
MGKGILSLQQEMSLEYSEKSYQEVLKIRQESYWKRMKSFSLFEVIMHWTASLNKHTCRSYRGSFLSLEKIGLLSLDMNLQEFSLLNHNLILDAIKKVSSAKTSWTEGTKQVRAASYISLTRFLNRMTQGIVAIAQPSKQENSRTFFKTREIVKTDAMNSLQTASFLKELKKINARDWLIAQTMLQGGKRSSEVLSLEISQICFQQATISFSQLKNRQTEKRIIITYPQKFMHFLQEYIGQRRGFVFVTRSGKMVGLRQIARTFSQAGLQAAIPFKITPHVLRATAVTEYKRLGCSDSDIMKVTGHATAKMIFAYDKSSREDNASKKMALI

SEQ ID NO: 9 - DNA, 7502 bp, Chlamydia trachomatis
ggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaattcctctagtacaaacacccacaatattgtgatataattaaaattatattcatattctgttgccagaaaaaacacctttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaacacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagagatttgcaactcttggtggtagactttgcaactcttggtggtagactttgcaactcttggtggtagactttgcaactcttggtggtagacttggtcataatggacttttgttaaaaaatttattaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaag

SEQ ID NO: 10 - protein, 451 aa, Chlamydia trachomatis
MKTRSEIENRMQDIEYALLGKALIFEDSTEYILRQLANYEFKCSHHKNIFIVFKHLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRVAFSENQNSFFDGFPTGYKDIDDKGVILAKGNFVIIAARPSIGKTALAIDMAINLAVTQQRRVGFLSLEMSAGQIVERIIANLTGISGEKLQRGDLSKEELFRVEEAGETVRESHFYICSDSQYKLNLIANQIRLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 11 - protein, 354 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPPTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQLEQESIN

SEQ ID NO: 12 - protein, 264 aa, Chlamydia trachomatis
MGNSGFYLYNTENCVFADNIKVGQMTEPLKDQQIILGTTSTPVAAKMTASDGISLTVSNNSSTNASITIGLDAEKAYQLILEKLGDQILDGIADTIVDSTVQDILDKIKTDPSLGLLKAFNNFPITNKIQCNGLFTPSNIETLLGGTEIGKFTVTPKSSGSMFLVSADIIASRMEGGVVLALVREGDSKPCAISYGYSSGIPNLCSLRTSITNTGLTPTTYSLRVGGLESGVVWVNALSNGNDILGITNTSNVSFLEVIPQTNA

SEQ ID NO: 13 - protein, 102 aa, Chlamydia trachomatis
MQNKRKVRDDFIKIVKDVKKDFPELDLKIRVNKEKVTFLNSPLELYHKSVSLILGLLQQIENSLGLFPDSPVLEKLEDNSLKLKKALIMLILSRKDMFSKAE

SEQ ID NO: 14 - protein, 243 aa, Chlamydia trachomatis
MGCNLAQFLGKKVLLADLDPQSNLSSGLGASVRSDQKGLHDIVYTSNDLKSIICETKKDSVDLIPASFSSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 15 - protein, 247 aa, Chlamydia trachomatis
MNKLKKEADVFFKKNQTAASLDFKKTLPSIELFSATLNSEESQSLDRLFLSESQNYSDEEFYQEDILAVKLLTGQIKSIQKQHVLLLGEKIYNARKILSKDHFSSTTFSSWIELVFRTKSSAYNALAYYELFINLPNQTLQKEFQSIPYKSAYILAARKGDLKTKVDVIGKVCGMSNSSAIRVLDQFLPSSRNKDVRETIDKSDSEKNRQLSDFLIEILRIMCSGVSLSSYNENLLQQLFELFKQKS

SEQ ID NO: 16 - protein, 305 aa, Chlamydia trachomatis
MGSMAFHKSRLFLTFGDASEIWLSTLSYLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFHSAMKIKITPRVLRASALIHLKQIGLKDEEIMRISCLSSRQSVCSYCSGEEVIPLVQTPTIL

SEQ ID NO: 17 - protein, 330 aa, Chlamydia trachomatis; identical to SEQ ID NO: 8

SEQ ID NO: 18 - DNA, 7500 bp, Chlamydia trachomatis
cgattaaattaagcttatactgactatcactgcagatataaaaatgtgattctctaactgtttctccagcttcttctactcggaataattcttctttagagagatcccctctttgtaatttttcaccagatattcctgttaaattagcaataatccgctcaacaatttgacctgcgctcatttctagagataggaaaccaactctacgctgttgagtaaccgcaagatttatcgccatgtctatagctaaagcagttttccctatagatggcctagctgctataatcacgaaattacctttagctaagataactcctttatcatcaatatccttgtatcctgttgggaaggcatcaaagaaagaattttgattctcagagaacgttgctcgtcttttttttatacgagccagcactccaatttctgactgtgagaatatatcataaatagaccggcctctagcgctgcgaatagaaaaagtctttgctatagcactgtcaagccttccctttatacgctcaagcaatagaaacggagatctacgcaatggattttcattgtactcattaaacgagcggaaaatgaaattactcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgagaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttacggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtccttggatatgaatctgcaagagttttcccttttaaatcataatctaattctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacagatgcgatgaacagtttgcaaacagcgtccttcctaaaagagctaaaaaaaatcaatgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacaggacacgcaaccgcaaagatgatatttgcgtacgataaatcttctcgagaagacaacgcttcaaagaagatggctctaatatagcctaaaagtgttttttctggcaacagaatatgaatataattttaattatatcacaatattgggggtgtttgtactagaggacttacctcttccccagaacaataagaacacacactttgtctcgatgaaagacaggaaatacgcatgatttcctcatcttttaatcctatttgctttaaatgaatcaaagcgcttgcacgaagtactctaggagtaatttttattttcatagcactatagaactctgcaagcctaaaattatgcgcaacctgacttgttgttacaggaatccctattttagaaacaaatactctcccatttctcccacaagtgtatttttgcaactcctccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaacctacttttatggaaagccatcgagcccattttcttaaccaaagctattcaaaatcggagctctaagattttaagaaatttttcaacaaaagtccattatgaccaagtctaccaccaagagttgcaaagtctaccaccaagagttgcaaagtctaccaccaagagttgcaaagtctaccaccaagagttgcaaatctctctcgtaaaatcaaatccctaaatatatatatataatagatatatatatgagctgacggaggatcagctcttttgcttaaaaagttcaaaaagctgttgtagaagattttcgttataggaggacaaagaaactccggaacacatgatgcgaagtatctctattaagaaatcagataattggcgattcttctctgaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataattgatccaaactctgactttcctcagaattcaaagttgctgagaatagttcaatggaaggaagcgtcttcttaaaatctaaagaagcggcagtttgattttttttaaaaaagacattcgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaagcaattaatttgtctcctgcaacaaaagcttctttcgttaaccctcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatgtgtatactatgtcgtgtaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttatctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcactttgcttttattttgcataacaaaccccgtaattcgaacttttttctctaaatataaaacctataagaaaaatccaataaaaattgtttaagcgtttgtttgaggtattacctccaaaaaagatacattagaagtatttgttattcctaaaatatcattgccattagaaagggcattaacccataccacaccgctttctaaaccgcctacacgtaatgaatacgttgtcggagtcaatcctgtattaataattctggttcttagactacataaattaggaacgcctgatgagtatccataactaatcgcgtagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgttcctgggagtgaataacccgttgcattgaattttattagtgattggaaagttgttaaaagctttcaacaaacctagagaagggtctgttgtgattttgtctaaaatatcttggactgtactatcaacaatagtatcagcaattccaccaagaatttgatctcccaacttttctagaataagctggtaagctttttccgcatccaaaccaattgtaatagaagcattggttgatggattattggagactgttaaagatattccatcagaagctgtcattttggctgcgacaggtgttgatgttgtcccaaggattatttgctggtccttgagcggctctgtcatttgcccaactttgatattatcagcaaagacgcagttttgagtgttatacaaataaaaaccagaatttcccattttaaaactcttttttattttgagctttaaataaattaggtttttagtttcaagtttgctattaattaatagattcttgttctaattgttccatttgttctttagatttcttagttatttcttcaaaacgctctttatttagatatagaatttcttttttagagagtttagaagaatccagaaattcaatgcgttttcttctagataaccaaccaagctgaatggcgatttctatacatttatcgatagctaactcgatttttttccagttccttgtacaaatgtaccgattcatccttaaaatatatgcaagacttttaacgttaacgtttaagaacaagttttctggccaagaattatccttagttaattttcgtctctttttcgcagctgctgtaatcacccagtcgataaatgtgtaagcatactttgatgcatttgggaagcgcatttttatttcttggtatacatttgcaggcttgattacaaagtaggattctatttgatctaccaagataggacatggctctacaacgaaccctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtataaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaacaaccccttttgtgttccccttgtaattcgttgcagtcagcaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaaccggatctgattcg

SEQ ID NO: 19 - protein, 451 aa, Chlamydia trachomatis; identical to SEQ ID NO: 1

SEQ ID NO: 20 - protein, 354 aa, Chlamydia trachomatis; identical to SEQ ID NO: 2

SEQ ID NO: 21 - protein, 264 aa, Chlamydia trachomatis; identical to SEQ ID NO: 3

SEQ ID NO: 22 - protein, 102 aa, Chlamydia trachomatis; identical to SEQ ID NO: 4

SEQ ID NO: 23 - protein, 243 aa, Chlamydia trachomatis
MGCNLAQFLGKKVLLADLDPQSNLSSGLGASVRSNQKGLHDIVYTSNDLKSIICETKKDSVDLIPASFLSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 24 - protein, 247 aa, Chlamydia trachomatis; identical to SEQ ID NO: 6

SEQ ID NO: 25 - protein, 305 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFYSAMKIKITPRVLRASALIHLKQIGLKDEEIMRISCLSSRQSVCSYCSGEEVSPLVQTPPIL

SEQ ID NO: 26 - protein, 330 aa, Chlamydia trachomatis; identical to SEQ ID NO: 8

SEQ ID NO: 27 - DNA, 7499 bp, Chlamydia trachomatis
tcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatgtgtatactatgtcgtgtaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttatctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcactttgcttttattttgcataacaaaccccgtaattcgaacttttttctctaaatataaaacctataagaaaaatccaataaaaattgtttaagcgtttgtttgaggtattacctccaaaaaagatacattagaagtatttgttattcctaaaatatcattgccattagaaagggcattaacccataccacaccgctttctaaaccgcctacacgtaatgaatacgttgtcggagtcaatcctgtattaataattctggttcttagactacataaattaggaacgcctgatgagtatccataactaatcgcgtagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgttcctgggagtgaataacccgttgcattgaattttattagtgattggaaagttgttaaaagctttcaacaaacctagagaagggtctgttgtgattttgtctaaaatatcttggactgtactatcaacaatagtatcagcaattccaccaagaatttgatctcccaacttttctagaataagctggtaagctttttccgcatccaaaccaattgtaatagaagcattggttgatggattattggagactgttaaagatattccatcagaagctgtcattttggctgcgacaggtgttgatgttgtcccaaggattatttgctggtccttgagcggctctgtcatttgcccaactttgatattatcagcaaagacgcagttttgagtgttatacaaataaaaaccagaatttcccattttaaaactcttttttattttgagctttaaataaattaggtttttagtttcaagtttgctattaattaatagattcttgttctaattgttccatttgttctttagatttcttagttatttcttcaaaacgctctttatttagatatagaatttcttttttagagagtttagaagaatccagaaattcaatgcgttttcttctagataaccaaccaagctgaatggcgatttctatacatttatcgatagctaactcgatttttttccagttccttgtacaaatgtaccgattcatccttaaaatatatgcaagacttttaacgttaacgtttaagaacaagttttctggccaagaattatccttagttaattttcgtctctttttcgcagctgctgtaatcacccagtcgataaatgtgtaagcatactttgatgcatttgggaagcgcatttttatttcttggtatacatttgcaggcttgattacaaagtaggattctatttgatctaccaagataggacatggctctacaacgaaccctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtataaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaacaaccccttttgtgttccccttgtaattcgttgcagtcagcaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaaccggatctgattcgcgattaaattaagcttatactgactatcactgcagatataaaaatgtgattctctaactgtttctccagcttcttctactcggaataattcttctttagagagatcccctctttgtaatttttcaccagatattcctgttaaattagcaataatccgctcaacaatttgacctgcgctcatttctagagataggaaaccaactctacgctgttgagtaaccgcaagatttatcgccatgtctatagctaaagcagttttccctatagatggcctagctgctataatcacgaaattacctttagctaagataactcctttatcatcaatatccttgtatcctgttgggaaggcatcaaagaaagaattttgattctcagagaacgttgctcgtcttttttttatacgagccagcactccaatttctgactgtgagaatatatcataaatagaccggcctctagcgctgcgaatagaaaaagtctttgctatagcactgtcaagccttccctttatacgctcaagcaatagaaacggagatctacgcaatggattttcattgtactcattaaacgagcggaaaatgaaattactcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgagaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttacggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtccttggatatgaatctgcaagagttttcccttttaaatcataatctaattctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacagatgcgatgaacagtttgcaaacagcgtccttcctaaaagagctaaaaaaaatcaatgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacaggacacgcaaccgcaaagatgatatttgcgtacgataaatcttctcgagaagacaacgcttcaaagaagatggctctaatatagcctaaaagtgttttttctggcaacagaatatgaatataattttaattatatcacaatattgggggtgtttgtactagaggacttacctcttccccagaacaataagaacacacactttgtctcgatgaaagacaggaaatacgcatgatttcctcatcttttaatcctatttgctttaaatgaatcaaagcgcttgcacgaagtactctaggagtaatttttttttcatagcactatagaactctgcaagcctaaaattatgcgcaacctgacttgttgttacaggaatccctattttagaaacaaatactctcccatttctcccacaagtgtatttttgcaactcctccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaacctacttttatggaaagccatcgagcccattttcttaaccaaagctattcaaaatcggagctctaagattttaagaaatttttcaacaaaagtccattatgaccaagtctaccaccaagagttgcaaagtctaccaccaagagttgcaaagtctaccaccaagagttgcaaagtctaccaccaagagttgcaaatctctctcgtaaaatcaaatccctaaatatatatatataatagatatatatatgagctgacggaggatcagctcttttgcttaaaaagttcaaaaagctgttgtagaagattttcgttataggaggacaaagaaactccggaacacatgatgcgaagtatctctattaagaaatcagataattggcgattcttctctgaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataattgatccaaactctgactttcctcagaattcaaagttgctgagaatagttcaatggaaggaagcgtcttcttaaaatctaaagaagcggcagtttgattttttttaaaaaagacattcgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaagcaattaatttgtctcctgcaacaaaagcttctttcgttaaccc

SEQ ID NO: 28 - protein, 451 aa, Chlamydia trachomatis; identical to SEQ ID NO: 1

SEQ ID NO: 29 - protein, 354 aa, Chlamydia trachomatis; identical to SEQ ID NO: 2

SEQ ID NO: 30 - protein, 264 aa, Chlamydia trachomatis; identical to SEQ ID NO: 3

SEQ ID NO: 31 - protein, 102 aa, Chlamydia trachomatis; identical to SEQ ID NO: 4

SEQ ID NO: 32 - protein, 133 aa, Chlamydia trachomatis; identical to SEQ ID NO: 5

SEQ ID NO: 33 - protein, 247 aa, Chlamydia trachomatis; identical to SEQ ID NO: 6

SEQ ID NO: 34 - protein, 260 aa, Chlamydia trachomatis; identical to SEQ ID NO: 7

SEQ ID NO: 35 - protein, 330 aa, Chlamydia trachomatis; identical to SEQ ID NO: 8

SEQ ID NO: 36 - DNA, 7493 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaattcctctagtacaaacacccacaatattgtgatataattaaaattatattcatattctgttgccagaaaaaacacctttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagaga

SEQ ID NO: 37 - protein, 451 aa, Chlamydia trachomatis
MKTRSEIENRMQDIEYALLGKALIFEDSTEYILRQLANYEFKCSHHKNIFIVFKYLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRVAFSENQNSFFDGFPTGYKDIDDKGVILAKGNFVIIAARPSIGKTALAIDMAINLAVTQQRRVGFLSLEMSAGQIVERIIANLTGISGEKLQRGDLSKEELFRVEEAGETVRESHFYICSDSQYKLNLIANQIRLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 38 - protein, 351 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPPTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQESIN

SEQ ID NO: 39 - protein, 264 aa, Chlamydia trachomatis; identical to SEQ ID NO: 12

SEQ ID NO: 40 - protein, 102 aa, Chlamydia trachomatis; identical to SEQ ID NO: 13

SEQ ID NO: 41 - protein, 264 aa, Chlamydia trachomatis
MHTLVFCSFKGGTGKTTLSLNVGCNLAQFLGKKVLLADLDPQSNLSSGLGASVRSDQKGLHDIVYTSNDLKSIICETKKDSVDLIPASFSSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 42 - protein, 247 aa, Chlamydia trachomatis; identical to SEQ ID NO: 15

SEQ ID NO: 43 - protein, 305 aa, Chlamydia trachomatis; identical to SEQ ID NO: 16

SEQ ID NO: 44 - protein, 330 aa, Chlamydia trachomatis; identical to SEQ ID NO: 8

SEQ ID NO: 45 - DNA, 7471 bp, Chlamydia trachomatis
tttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaattcctctagtacaaacacccacaatattgtgatataattaaaattatattcatattctgttgccagaaaaaacacctttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagaga

SEQ ID NO: 46 - protein, 451 aa, Chlamydia trachomatis; identical to SEQ ID NO: 37

SEQ ID NO: 47 - protein, 351 aa, Chlamydia trachomatis; identical to SEQ ID NO: 38

SEQ ID NO: 48 - protein, 264 aa, Chlamydia trachomatis; identical to SEQ ID NO: 12

SEQ ID NO: 49 - protein, 102 aa, Chlamydia trachomatis; identical to SEQ ID NO: 13

SEQ ID NO: 50 - protein, 264 aa, Chlamydia trachomatis; identical to SEQ ID NO: 41

SEQ ID NO: 51 - protein, 247 aa, Chlamydia trachomatis; identical to SEQ ID NO: 15

SEQ ID NO: 52 - protein, 305 aa, Chlamydia trachomatis; identical to SEQ ID NO: 16

SEQ ID NO: 53 - protein, 330 aa, Chlamydia trachomatis; identical to SEQ ID NO: 8

SEQ ID NO: 54 - DNA, 7502 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctctcatcgagacaaagtgtgtgttcttattgttctggggaagaggtaagtcctctagtacaaacacccacaatattgtgatataattaaaattatattcatattctgttgccagaaaaaacacctttaggctatattagagccatcttctttgaagcgttgtcttctcgagaggatttatcgtacgcaaatatcatctttgcggttgcgtgtcccgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcgttgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaagacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgcaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttcccatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagcaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacaggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccagttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttattttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgtattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgataatacagtccaagatattttagacaaaatcaaaacagacccttctctaggtttgttgaaagcttttaacaactttccaatcactaataaaattcaatgcaacgggttattcactcccagtagcattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgactccaacaacgtattcattacgtgtaggcggtttagaaagcggtgtggtatgggttaatgccctttctaatggcaatgatattttaggaataacaaatacttctaatgtatcttttttggaagtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttgcacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgtttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacacttccttccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatatgttccggagtttctttgtcctcctataacgaaaatcttctacaacagctttttgaactttttaagcaaaagagctgatcctccgtcagctcatatatatatttattatatatatatttatttagggatttgattttacgagagaga

SEQ ID NO: 55 - protein, 451 aa, Chlamydia trachomatis
MKTRSEIENRMQDIEYALLGKALIFEDSTEYILRQLANYEFKCSHHKNIFIVFKYLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRAAFSENQNSFFDGFPTGYKDIDDKGVILAKGNFVIIAARPSIGKTALAIDMAINLAVTQQRRVGFLSLEMSAGQIVERIIANLTGISGEKLQRGDLSKEELFRVEEAGETVRESHFYICSDSQYKLNLIANQIQLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 56 - protein, 310 aa, Chlamydia trachomatis
GLDFLSSHYHALAAIQRLLTATNYKGNTKGVILSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQLEQESIN

SEQ ID NO: 57 - protein, 264 aa, Chlamydia trachomatis
MGNSGFYLYNTENCVFADNIKVGQMTEPLKDQQIILGTTSTPVAAKMTASDGISLTVSNNSSTNASITIGLDAEKAYQLILEKLGDQILDGIADTIVDNTVQDILDKIKTDPSLGLLKAFNNFPITNKIQCNGLFTPSSIETLLGGTEIGKFTVTPKSSGSMFLVSADIIASRMEGGVVLALVREGDSKPCAISYGYSSGVPNLCSLRTSITNTGLTPTTYSLRVGGLESGVVWVNALSNGNDILGITNTSNVSFLEVIPQTNA

SEQ ID NO: 58 - protein, 102 aa, Chlamydia trachomatis; identical to SEQ ID NO: 13

SEQ ID NO: 59 - protein, 264 aa, Chlamydia trachomatis
MHTLVFCSFKGGTGKTTLSLNVGCNLAQFLGKKVLLADLDPQSNLSSGLGASVRSNQKGLHDIVYTSNDLKSIICETKKDSVDLIPASFLSEQFRELDIHRGPSNNLKLFLNEYCAPFYDICIIDTPPSLGGLTKEAFVAGDKLIVCLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 60 - protein, 247 aa, Chlamydia trachomatis
MNKLKKEADVFFKKNQTAASLDFKKTLPSIELFSATLNSEESQSLDRLFLSESQNYSDEEFYQEDILAVKLLTGQIKSIQKQHVLLLGEKIYNARKILSKDHFSSTTFSSWIELVFRTKSSAYNALAYYELFINLPNQTLQKEFQSIPYKSAYILAARKGDLKTKVDVIGKVCGMSNSSAIRVLDQFLPSSRNKDVRETIDKSDSEKNRQLSDFLIEILRIICSGVSLSSYNENLLQQLFELFKQKS

SEQ ID NO: 61 - protein, 305 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFHSAMKIKITPRVLRASALIHLKQIGLKDEEIMRISCLSSRQSVCSYCSGEEVSPLVQTPTIL

SEQ ID NO: 62 - protein, 330 aa, Chlamydia trachomatis; identical to SEQ ID NO: 8

SEQ ID NO: 63 - DNA, 7169 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtttgttctggggaagaggtaattcctctagtacaaacacccacaatattgtgatataattaaaattatattcatattctgttgccagaaaaaacacctttaggctatattagagccagcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattaagcttggctggttatctagaagaaaacgcattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagaga

SEQ ID NO: 64 - protein, 451 aa, Chlamydia trachomatis; identical to SEQ ID NO: 37

SEQ ID NO: 65 - protein, 354 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPPTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIKLGWLSRRKRIEFLDSSKLSKKEILYLNKERFEEITKKSKEQMEQLEQESIN

SEQ ID NO: 66 - protein, 264 aa, Chlamydia trachomatis; identical to SEQ ID NO: 12

SEQ ID NO: 67 - protein, 102 aa, Chlamydia trachomatis; identical to SEQ ID NO: 13

SEQ ID NO: 68 - protein, 264 aa, Chlamydia trachomatis; identical to SEQ ID NO: 41

SEQ ID NO: 69 - protein, 247 aa, Chlamydia trachomatis; identical to SEQ ID NO: 15

SEQ ID NO: 70 - protein, 179 aa, Chlamydia trachomatis
MGSMAFHKSRLFLTFGDASEIWLSTLSYLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRCSGEEVIPLVQTPTIL

SEQ ID NO: 71 - protein, 330 aa, Chlamydia trachomatis
MGKGILSLQQEMSLEYSEKSYQEVLKIRQESYWKRMKSFSLFEVIMHWTASLNKHTCRSYRGSFLSLEKIGLLSLDMNLQEFSLLNHNLILDAIKKVSSAKTSWTEGTKQVRAASYISLTRFLNRMTQGIVAIAQPSKQENSRTFFKTREIVKTDAMNSLQTASFLKELKKINARDWLIAQTMLQGGKRSSEVLSLEISQICFQQATISFSQLKNRQTEKRIIITYPQKFMHFLQEYIGQRRGFVFVTRSGKMVGLRQIARTFSQAGLQAAIPFKITPHVLRATAVTEYKRLGCSDSDIMKVTGHATAKMIFAYDKSSREDNASKKLALI

SEQ ID NO: 72 - DNA, 7502 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaattcctctagtacaaacacccacaatattgtgatataattaaaattatattcatattctgttgccagaaaaaacacctttaggctatattagagccagcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagaga

SEQ ID NO: 73 - protein, 451 aa, Chlamydia trachomatis; identical to SEQ ID NO: 37

SEQ ID NO: 74 - protein, 354 aa, Chlamydia trachomatis; identical to SEQ ID NO: 11

SEQ ID NO: 75 - protein, 264 aa, Chlamydia trachomatis; identical to SEQ ID NO: 12

SEQ ID NO: 76 - protein, 102 aa, Chlamydia trachomatis; identical to SEQ ID NO: 13

SEQ ID NO: 77 - protein, 264 aa, Chlamydia trachomatis; identical to SEQ ID NO: 41

SEQ ID NO: 78 - protein, 247 aa, Chlamydia trachomatis; identical to SEQ ID NO: 15

SEQ ID NO: 79 - protein, 305 aa, Chlamydia trachomatis; identical to SEQ ID NO: 16

SEQ ID NO: 80 - protein, 330 aa, Chlamydia trachomatis; identical to SEQ ID NO: 71

SEQ ID NO: 81 - DNA, 7502 bp, Chlamydia trachomatis; identical to SEQ ID NO: 54

SEQ ID NO: 82 - protein, 451 aa, Chlamydia trachomatis; identical to SEQ ID NO: 55

SEQ ID NO: 83 - protein, 354 aa, Chlamydia trachomatis
MVNYSNCHFIKSPIHLENQKFGRRPGQSIKISPKLAQNGMVEVIGLDFLSSHYHALAAIQRLLTATNYKGNTKGVILSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQLEQESIN

SEQ ID NO: 84 - protein, 264 aa, Chlamydia trachomatis; identical to SEQ ID NO: 57

SEQ ID NO: 85 - protein, 102 aa, Chlamydia trachomatis; identical to SEQ ID NO: 13

SEQ ID NO: 86 - protein, 264 aa, Chlamydia trachomatis; identical to SEQ ID NO: 59

SEQ ID NO: 87 - protein, 247 aa, Chlamydia trachomatis; identical to SEQ ID NO: 60

SEQ ID NO: 88 - protein, 305 aa, Chlamydia trachomatis; identical to SEQ ID NO: 61

SEQ ID NO: 89 - protein, 330 aa, Chlamydia trachomatis; identical to SEQ ID NO: 8

SEQ ID NO: 90 - DNA, 7502 bp, Chlamydia trachomatis; identical to SEQ ID NO: 72

SEQ ID NO: 91 - protein, 451 aa, Chlamydia trachomatis; identical to SEQ ID NO: 37

SEQ ID NO: 92 - protein, 354 aa, Chlamydia trachomatis; identical to SEQ ID NO: 11

SEQ ID NO: 93 - protein, 264 aa, Chlamydia trachomatis; identical to SEQ ID NO: 12

SEQ ID NO: 94 - protein, 102 aa, Chlamydia trachomatis; identical to SEQ ID NO: 13

SEQ ID NO: 95 - protein, 264 aa, Chlamydia trachomatis; identical to SEQ ID NO: 41

SEQ ID NO: 96 - protein, 247 aa, Chlamydia trachomatis; identical to SEQ ID NO: 15

SEQ ID NO: 97 - protein, 305 aa, Chlamydia trachomatis; identical to SEQ ID NO: 16

SEQ ID NO: 98 - protein, 330 aa, Chlamydia trachomatis; identical to SEQ ID NO: 71

SEQ ID NO: 99 - DNA, 7500 bp, Chlamydia trachomatis
tttgcaactcttggtggtagactttgcaactcttggtggtagactttgcaactcttggtggtagactttgcaactcttggtggtagacttggtcataatggacttttgttgaaaaatttcttaaaatcttagagctccgattttgaatagctttggttaagaaaatgggctcgatggctttccataaaagtaggttgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaataaaaattactcctagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccccaatattgtgatataattaaaattatattcatattctgttgccagaaaaaacacttttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggacgctgtttgcaaactgttcatcgcatctgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctagaattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagcttggttggttatctagaagaaaacgcattgaatttctggattcttctaaactctctaaaaaagaaattctatatctaaataaagagcgttttgaagaaataactaagaaatctaaagaacaaatggaacaattagaacaagaatctattaattaatagcaaacttgaaactaaaaacctaatttatttaaagctcaaaataaaaaagagttttaaaatgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagataacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagaga

SEQ ID NO: 100 - protein, 451 aa, Chlamydia trachomatis; identical to SEQ ID NO: 1

SEQ ID NO: 101 - protein, 354 aa, Chlamydia trachomatis; identical to SEQ ID NO: 2

SEQ ID NO: 102 - protein, 264 aa, Chlamydia trachomatis; identical to SEQ ID NO: 3

SEQ ID NO: 103 - protein, 102 aa, Chlamydia trachomatis; identical to SEQ ID NO: 4

SEQ ID NO: 104 - protein, 264 aa, Chlamydia trachomatis
MHTLVFCSFKGGTGKTTLSLNVGCNLAQFLGKKVLLADLDPQSNLSSGLGASVRSNQKGLHDIVYTSNDLKSIICETKKDSVDLIPASFLSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 105 - protein, 247 aa, Chlamydia trachomatis; identical to SEQ ID NO: 6

SEQ ID NO: 106 - protein, 305 aa, Chlamydia trachomatis; identical to SEQ ID NO: 25

SEQ ID NO: 107 - protein, 330 aa, Chlamydia trachomatis; identical to SEQ ID NO: 8

SEQ ID NO: 108 - DNA, 7500 bp, Chlamydia trachomatis
tttgcaactcttggtggtagactttgcaactcttggtggtagactttgcaactcttggtggtagactttgcaactcttggtggtagacttggtcataatggacttttgttgaaaaatttcttaaaatcttagagctccgattttgaatagctttggttaagaaaatgggctcgatggctttccataaaagtaggttgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaaaaaaaattactcctagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccccaatattgtgatataattaaaattatattcatattctgttgccagaaaaaacacttttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggacgctgtttgcaaactgttcatcgcatctgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctagaattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagattggttggttatctagaagaaaacgcattgaatttctggattcttctaaactctctaaaaaagaaattctatatctaaataaagagcgttttgaagaaataactaagaaatctaaagaacaaatggaacaattagaacaagaatctattaattaatagcaaacttgaaactaaaaacctaatttatttaaagctcaaaataaaaaagagttttaaaatgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagataacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagaga

SEQ ID NO: 109 - protein, 451 aa, Chlamydia trachomatis; identical to SEQ ID NO: 1

SEQ ID NO: 110 - protein, 354 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLFLNVNVKSLAYILRMNRYICTRNWKKIELAIDKCIEIAIQIGWLSRRKRIEFLDSSKLSKKEILYLNKERFEEITKKSKEQMEQLEQESIN

SEQ ID NO: 111 - protein, 264 aa, Chlamydia trachomatis; identical to SEQ ID NO: 3

SEQ ID NO: 112 - protein, 102 aa, Chlamydia trachomatis; identical to SEQ ID NO: 4

SEQ ID NO: 113 - protein, 264 aa, Chlamydia trachomatis; identical to SEQ ID NO: 104

SEQ ID NO: 114 - protein, 247 aa, Chlamydia trachomatis; identical to SEQ ID NO: 6

SEQ ID NO: 115 - protein, 305 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFYSAMKKKITPRVLRASALIHLKQIGLKDEEIMRISCLSSRQSVCSYCSGEEVSPLVQTPPIL

SEQ ID NO: 116 - protein, 330 aa, Chlamydia trachomatis; identical to SEQ ID NO: 8

SEQ ID NO: 117 - DNA, 7473 bp, Chlamydia trachomatis
aactcttggtggtagactttgcaactcttggtggtagactttgcaactcttggtggtagacttggtcataatggacttttgttgaaaaatttcttaaaatcttagagctccgattttgaatagctttggttaagaaaatgggctcgatggctttccataaaagtaggttgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaataaaaattactcctagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccccaatattgtgatataattaaaattatattcatattctgttgccagaaaaaacacttttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggacgctgtttgcaaactgttcatcgcatctgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctagaattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagcttggttggttatctagaagaaaacgcattgaatttctggattcttctaaactctctaaaaaagaaattctatatctaaataaagagcgttttgaagaaataactaagaaatctaaagaacaaatggaacaattagaacaagaatctattaattaatagcaaacttgaaactaaaaacctaatttatttaaagctcaaaataaaaaagagttttaaaatgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagataacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagaga

SEQ ID NO: 118 - protein, 451 aa, Chlamydia trachomatis; identical to SEQ ID NO: 1

SEQ ID NO: 119 - protein, 354 aa, Chlamydia trachomatis; identical to SEQ ID NO: 2

SEQ ID NO: 120 - protein, 264 aa, Chlamydia trachomatis; identical to SEQ ID NO: 3

SEQ ID NO: 121 - protein, 102 aa, Chlamydia trachomatis; identical to SEQ ID NO: 4

SEQ ID NO: 122 - protein, 264 aa, Chlamydia trachomatis; identical to SEQ ID NO: 104

SEQ ID NO: 123 - protein, 247 aa, Chlamydia trachomatis; identical to SEQ ID NO: 6

SEQ ID NO: 124 - protein, 305 aa, Chlamydia trachomatis; identical to SEQ ID NO: 25

SEQ ID NO: 125 - protein, 330 aa, Chlamydia trachomatis; identical to SEQ ID NO: 8

SEQ ID NO: 126 - DNA, 7415 bp, Chlamydia trachomatis
tttgcaactcttggtggtagactttgcaactcttggtggtagactttgcaactcttggtggtagactttgcaactcttggtggtagacttggtcataatggacttttgttgaaaaatttcttaaaatcttagagctccgattttgaatagctttggttaagaaaatgggctcgatggctttccataaaagtaggttgttcttaacttttggggacgcgtcggaaattcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctatttttttcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaataaaaattactcctagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccccaatattgtgatataattaaaattatattcatattctgttgccagaaaaaacacttttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggacgctgtttgcaaactgttcatcgcatctgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctagaattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgcttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagcttggttggttatctagaagaaaacgcattgaatttctggattcttctaaactctctaaaaaagaaattctatatctaaataaagagcgttttgaagaaataaccaagaaatctaaagaacaaatggaacaattagaacaagaatctattaattaatagcaaacttgaaactaaaaacctaatttatttaaagctcaaaataaaaaagagttttaaaatgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagataacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagaga

SEQ ID NO: 127 - protein, 451 aa, Chlamydia trachomatis; identical to SEQ ID NO: 1

SEQ ID NO: 128 - protein, 354 aa, Chlamydia trachomatis; identical to SEQ ID NO: 2

SEQ ID NO: 129 - protein, 264 aa, Chlamydia trachomatis; identical to SEQ ID NO: 3

SEQ ID NO: 130 - protein, 102 aa, Chlamydia trachomatis; identical to SEQ ID NO: 4

SEQ ID NO: 131 - protein, 264 aa, Chlamydia trachomatis; identical to SEQ ID NO: 104

SEQ ID NO: 132 - protein, 247 aa, Chlamydia trachomatis; identical to SEQ ID NO: 6

SEQ ID NO: 133 - protein, 330 aa, Chlamydia trachomatis; identical to SEQ ID NO: 8

SEQ ID NO: 134 - DNA, 7492 bp, Chlamydia trachomatis
tttgcaactcttggtggtagactttgcaactcttggtggtagactttgcaatcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctctcatcgagacaaagtgtgtgttcttattgttctggggaagaggtaagtcctctagtacaaacacccacaatattgtgatataattaaaattatattcatattctgttgccagaaaaaacacctttaggctatattagagccatcttctttgaagcgttgtcttctcgagaggatttatcgtacgcaaatatcatctttgcggttgcgtgtcccgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcgttgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaagacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgcaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttcccatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagcaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacaggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattgttgctaatttaacaggaatatctggtgaaaaattacaaagaggggatctctctaaagaagaattattccgagtggaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttgtaccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaaggattcgttgtagagccatgtcctatcttggtagatcaaatagaatcctactttgtaatcaagcctgcaaatgtataccaagaaataaaaatgcgtttcccaaacgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaagaatctattaattaatagcaggcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaaaatcaacacctgtcgcagccaaaatgacagcttctgatggaatatctttaacagtctccaataattcatcaaccaatgcttctattacaattggtttggatgcggaaaaagcttaccagcttattctagaaaagttgggaaatcaaattcttgatggaattgctgatactattgttgatagtacagtccaagatattttagacaaaatcacaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgactccaacaacgtattcattacgtgtaggcggtttagaaagcggtgtggtatgggttaatgccctttctaatggcaatgatattttaggaataacaaatacttctaatgtatcttttttggaagtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaaataaccaaaaaggcttgcacgacatagtatacaaatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacacttccttccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgatttagagaagaatcgccaattatctgatttcttaatagagatacttcgcatcatatgttccggagtttctttgtcctcctataacgaaaatcttctacaacagctttttgaactttttaagcaaaagagctgatcctccgtcagctcatatatatatttattatatatatatttatttagggatttgattttacgagagaga

SEQ ID NO: 135 - protein, 451 aa, Chlamydia trachomatis
MKTRSEIENRMQDIEYALLGKALIFEDSTEYILRQLANYEFKCSHHKNIFIVFKYLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRAAFSENQNSFFDGFPTGYKDIDDKGVILAKGNFVIIAARPSIGKTALAIDMAINLAVTQQRRVGFLSLEMSAGQIVERIVANLTGISGEKLQRGDLSKEELFRVEEAGETVRESHFYICSDSQYKLNLIANQIRLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 136 - protein, 351 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQESIN

SEQ ID NO: 137 - protein, 264 aa, Chlamydia trachomatis
MGNSGFYLYNTENCVFADNIKVGQMTEPLKDQQIILGTKSTPVAAKMTASDGISLTVSNNSSTNASITIGLDAEKAYQLILEKLGNQILDGIADTIVDSTVQDILDKITTDPSLGLLKAFNNFPITNKIQCNGLFTPSNIETLLGGTEIGKFTVTPKSSGSMFLVSADIIASRMEGGVVLALVREGDSKPCAISYGYSSGVPNLCSLRTSITNTGLTPTTYSLRVGGLESGVVWVNALSNGNDILGITNTSNVSFLEVIPQTNA

SEQ ID NO: 138 - protein, 102 aa, Chlamydia trachomatis; identical to SEQ ID NO: 13

SEQ ID NO: 139 - protein, 264 aa, Chlamydia trachomatis
MHTLVFCSFKGGTGKTTLSLNVGCNLAQFLGKKVLLADLDPQSNLSSGLGASVRNNQKGLHDIVYKSNDLKSIICETKKDSVDLIPASFLSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 140 - protein, 247 aa, Chlamydia trachomatis
MNKLKKEADVFFKKNQTAASLDFKKTLPSIELFSATLNSEESQSLDRLFLSESQNYSDEEFYQEDILAVKLLTGQIKSIQKQHVLLLGEKIYNARKILSKDHFSSTTFSSWIELVFRTKSSAYNALAYYELFINLPNQTLQKEFQSIPYKSAYILAARKGDLKTKVDVIGKVCGMSNSSAIRVLDQFLPSSRNKDVRETIDKSDLEKNRQLSDFLIEILRIICSGVSLSSYNENLLQQLFELFKQKS

SEQ ID NO: 141 - protein, 305 aa, Chlamydia trachomatis; identical to SEQ ID NO: 61

SEQ ID NO: 142 - protein, 330 aa, Chlamydia trachomatis; identical to SEQ ID NO: 8

SEQ ID NO: 143 - DNA, 7502 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgtttttaacttttggggacgcgtcggaaatttggttatctactttatcttatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagttgtttcagaggcatctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaattcctctagtacaaacacccacaatattgtgatataattaaaattatattcatattctgttgccagaaaaaacacctttaggctatattagagccagcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttattttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcactatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagtagcgttctctgagaatcaaaattctttctttgatggcttcccaacaggatacaaggatattgatgataaaggagttatcttagctaaaggtaatttcgtgattatagcagctagaccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacggttagagaatcacatttttatatctgcagtgatagtcagtataagcttaacttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccacctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgatagtacagtccaagatattttagacaaaatcaaaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcattcctaatttatgtagtctaagaaccagtattactaatacaggattgactccgacaacgtattcattacgtgtaggcggtttagaaagcggtgtggtatgggttaatgccctttctaatggcaatgatattttaggaataacaaatacttctaatgtatcttttttagaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtgaccaaaaaggcttgcacgacatagtatacacatcaaacgatttaaaatcaatcatttgcgaaacaaaaaaagatagtgtggacctaattcctgcatcattttcatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacgcttccctccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaaggcgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatatctattatatatatatatttagggatttgatttcacgagagaga

SEQ ID NO: 144 - protein, 451 aa, Chlamydia trachomatis; identical to SEQ ID NO: 37

SEQ ID NO: 145 - protein, 354 aa, Chlamydia trachomatis; identical to SEQ ID NO: 11

SEQ ID NO: 146 - protein, 264 aa, Chlamydia trachomatis; identical to SEQ ID NO: 12

SEQ ID NO: 147 - protein, 102 aa, Chlamydia trachomatis; identical to SEQ ID NO: 13

SEQ ID NO: 148 - protein, 264 aa, Chlamydia trachomatis; identical to SEQ ID NO: 41

SEQ ID NO: 149 - protein, 247 aa, Chlamydia trachomatis
MNKLKKEADVFFKKNQTAASLDFKKTLPSIELFSATLNSEESQSLDRLFLSESQNYSDEEFYQEDILAVKLLTGQIKSIQKQHVLLLGEKIYNARKILSKDHFSSTTFSSWIELVFRTKSSAYNALAYYELFINLPNQTLQKEFQSIPYKSAYILAARKGDLKTKVDVIGKVCGMSNSSAIRVLDQFLPSSRNKGVRETIDKSDSEKNRQLSDFLIEILRIMCSGVSLSSYNENLLQQLFELFKQKS

SEQ ID NO: 150 - protein, 305 aa, Chlamydia trachomatis; identical to SEQ ID NO: 16

SEQ ID NO: 151 - protein, 330 aa, Chlamydia trachomatis; identical to SEQ ID NO: 71

SEQ ID NO: 152 - DNA, 7493 bp, Chlamydia trachomatis; identical to SEQ ID NO: 36

SEQ ID NO: 153 - protein, 451 aa, Chlamydia trachomatis; identical to SEQ ID NO: 37

SEQ ID NO: 154 - protein, 351 aa, Chlamydia trachomatis; identical to SEQ ID NO: 38

SEQ ID NO: 155 - protein, 264 aa, Chlamydia trachomatis; identical to SEQ ID NO: 12

SEQ ID NO: 156 - protein, 102 aa, Chlamydia trachomatis; identical to SEQ ID NO: 13

SEQ ID NO: 157 - protein, 264 aa, Chlamydia trachomatis; identical to SEQ ID NO: 41

SEQ ID NO: 158 - protein, 247 aa, Chlamydia trachomatis; identical to SEQ ID NO: 15

SEQ ID NO: 159 - protein, 305 aa, Chlamydia trachomatis; identical to SEQ ID NO: 16

SEQ ID NO: 160 - protein, 330 aa, Chlamydia trachomatis; identical to SEQ ID NO: 8

SEQ ID NO: 161 - DNA, 7471 bp, Chlamydia trachomatis
tttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctctcatcgagacaaagtgtgtgttcttattgttctggggaagaggtaagtcctctagtacaaacacccacaatattgtgatataattaaaattatattcatattctgttgccagaaaaaacacctttaggctatattagagccatcttctttgaagcgttgtcttctcgagaggatttatcgtacgcaaatatcatctttgcggttgcgtgtcccgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcgttgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaagacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgcaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttcccatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagcaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacaggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattgttgctaatttaacaggaatatctggtgaaaaattacaaagaggggatctctctaaagaagaattattccgagtggaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttgtaccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaaggattcgttgtagagccatgtcctatcttggtagatcaaatagaatcctactttgtaatcaagcctgcaaatgtataccaagaaataaaaatgcgtttcccaaacgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaagaatctattaattaatagcaggcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaaaatcaacacctgtcgcagccaaaatgacagcttctgatggaatatctttaacagtctccaataattcatcaaccaatgcttctattacaattggtttggatgcggaaaaagcttaccagcttattctagaaaagttgggaaatcaaattcttgatggaattgctgatactattgttgatagtacagtccaagatattttagacaaaatcacaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgactccaacaacgtattcattacgtgtaggcggtttagaaagcggtgtggtatgggttaatgccctttctaatggcaatgatattttaggaataacaaatacttctaatgtatcttttttggaagtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaaataaccaaaaaggcttgcacgacatagtatacaaatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacacttccttccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgatttagagaagaatcgccaattatctgatttcttaatagagatacttcgcatcatatgttccggagtttctttgtcctcctataacgaaaatcttctacaacagctttttgaactttttaagcaaaagagctgatcctccgtcagctcatatatatatttattatatatatatttatttagggatttgattttacgagagaga

SEQ ID NO: 162 - protein, 451 aa, Chlamydia trachomatis; identical to SEQ ID NO: 135

SEQ ID NO: 163 - protein, 351 aa, Chlamydia trachomatis; identical to SEQ ID NO: 136

SEQ ID NO: 164 - protein, 264 aa, Chlamydia trachomatis; identical to SEQ ID NO: 137

SEQ ID NO: 165 - protein, 102 aa, Chlamydia trachomatis; identical to SEQ ID NO: 13

SEQ ID NO: 166 - protein, 264 aa, Chlamydia trachomatis; identical to SEQ ID NO: 139

SEQ ID NO: 167 - protein, 247 aa, Chlamydia trachomatis; identical to SEQ ID NO: 140

SEQ ID NO: 168 - protein, 305 aa, Chlamydia trachomatis; identical to SEQ ID NO: 61

SEQ ID NO: 169 - protein, 330 aa, Chlamydia trachomatis; identical to SEQ ID NO: 8

SEQ ID NO: 170 - DNA, 7500 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcagaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagaatatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccacaatattgtgatataattaaaattatattcatattctgttgccagaaaaaacacctttaggctatattagagccgtcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttgcctccttggagcattgtctgggcgatcaaccaatcccgggcattgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaggaagtcttggcagaggaaacttttttaatcgcatctaggattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtagtataacctatccgtaaaatgtcctgattatttcactaatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacaggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtggaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttgtaccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgtttcccaaacgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaattagaacaataatctattaattaatagcaggcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggaaatcaaattcttgatggaattgctgatactattgttgatagtacagtccaagatattttagacaaaatcacaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcagcgttgttctagctttggtacgagaaggtgattctaagccctgcgcgattagttatggatactcatcaggcgttcctaatttatgtagtctaagaaccagcattactaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaaggggggaactggaaaaacaacactttctctaaacgtgggatgcaacttggcccaatttttagggaaaaaagtgttacttgctgacctagacccacaatccaatttatcttctggattgggggctagtgtcagaagtaaccaaaaaggcttgcacgacatagtatacacatcaaacgatttaaaatcaatcatttgcgaaacaaaaaaagatagtgtggacctaattcctgcatcatttttatctgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctcttagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgttttttttaaaaaaaatcaaactgccgcttctctagattttaagaagacacttccttccattgaactattctcagcaactttgaattctgaggaaagtcagagtttggatcgattatttttgtcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcgacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagagc

SEQ ID NO: 171 - protein, 451 aa, Chlamydia trachomatis
MKTRSEIENRMQDIEYALLGKALIFEDSTEYILRQLANYEFKCSHHKNIFIVFKYLKDNGLPITVDSAWEELLRRRIKDMDKSYLGLMLHDALSNDKLRSVSHTVFLDDLSVCSAEENLSNFIFRSFNEYNENPLRRSPFLLLERIKGRLDSAIAKTFSIRSARGRSIYDIFSQSEIGVLARIKKRRAAFSENQNSFFDGFPTGYKDIDDKGVILAKGNFVIIAARPSIGKTALAIDMAINLAVTQQRRVGFLSLEMSAGQIVERIIANLTGISGEKLQRGDLSKEELFRVEEAGETVRESHFYICSDSQYKLNLIANQIRLLRKEDRVDVIFIDYLQLINSSVGENRQNEIADISRTLRGLASELNIPIVCLSQLSRKVEDRANKVPMLSDLRDSGQIEQDADVILFINRKESSSNCEITVGKNRHGSVFSSVLHFDPKISKFSAIKKVW

SEQ ID NO: 172 - protein, 350 aa, Chlamydia trachomatis
MVNYSNCHFIKSPIHLENQKFGRRPGQSIKISPKLAQNGMVEVIGLDFLSSHYHALAAIQRLLTATNYKGNTKGVVLSRESNSFQFEGWIPRIRFTKTEFLEAYGVKRYKTSRNKYEFSGKEAETALEALYHLGHQPFLIVATRTRWTNGTQIVDRYQTLSPIIRIYEGWEGLTDEENIDIDLTPFNSPSTRKHKGFVVEPCPILVDQIESYFVIKPANVYQEIKMRFPNASKYAYTFIDWVITAAAKKRRKLTKDNSWPENLLLNVNVKSLAYILRMNRYICTRNWKKIELAIDKCIEIAIQLGWLSRRKRIEFLDSSKLSKKEILYLNKERFEEITKKSKEQMEQLEQ

SEQ ID NO: 173 - protein, 264 aa, Chlamydia trachomatis
MGNSGFYLYNTENCVFADNIKVGQMTEPLKDQQIILGTTSTPVAAKMTASDGISLTVSNNSSTNASITIGLDAEKAYQLILEKLGNQILDGIADTIVDSTVQDILDKITTDPSLGLLKAFNNFPITNKIQCNGLFTPSNIETLLGGTEIGKFTVTPKSSGSMFLVSADIIASRMEGSVVLALVREGDSKPCAISYGYSSGVPNLCSLRTSITNTGLTPTTYSLRVGGLESGVVWVNALSNGNDILGITNTSNVSFLEVIPQTNA

SEQ ID NO: 174 - protein, 102 aa, Chlamydia trachomatis; identical to SEQ ID NO: 13

SEQ ID NO: 175 - protein, 264 aa, Chlamydia trachomatis; identical to SEQ ID NO: 104

SEQ ID NO: 176 - protein, 247 aa, Chlamydia trachomatis; identical to SEQ ID NO: 15

SEQ ID NO: 177 - protein, 305 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRIFVSKIGIPVTTSQVAHNFRLAEFHSAMKIKITPRVLRASALIHLKQIGLKDEEIMRISCLSSRQSVCSYCSGEEVSPLVQTPTIL

SEQ ID NO: 178 - protein, 330 aa, Chlamydia trachomatis
MGKGILSLQQEMSLEYSEKSYQEVLKIRQESYWKRMKSFSLFEVIMHWTASLNKHTCRSYRGSFLSLEKIGLLSLDMNLQEFSLLNHNLILDAIKKVSSAKTSWTEGTKQVRAASYISLTRFLNRMTQGIVAIAQPSKQENSRTFFKTREIVKTDAMNSLQTASFLKELKKINARDWLIAQTMLQGGKRSSEVLSLEISQICFQQATISFSQLKNRQTEKRIIITYPQKFMHFLQEYIGQRRGFVFVTRSGKMVGLRQIARTFSQAGLQAAIPFKITPHVLRATAVTEYKRLGCSDSDIMKVTGHATAKMIFAYDKSSREDNASKKTALI

SEQ ID NO: 179 - DNA, 7493 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttgtgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctctcatcgagacaaagtgtgtgttcttattgttctggggaagaggtaagtcctctagtacaaacacccacaatattgtgatataattaaaattatattcatattctgttgccagaaaaaacacctttaggctatattagagccatcttctttgaagcgttgtcttctcgagaggatttatcgtacgcaaatatcatctttgcggttgcgtgtcccgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcgttgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaagacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgcaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttcccatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagcaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacaggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattgttgctaatttaacaggaatatctggtgaaaaattacaaagaggggatctctctaaagaagaattattccgagtggaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttgtaccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaaggattcgttgtagagccatgtcctatcttggtagatcaaatagaatcctactttgtaatcaagcctgcaaatgtataccaagaaataaaaatgcgtttcccaaacgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgcattgaatttctggattcttctaaactctctaaaaaagaaattctatatctaaataaagagcgctttgaagaaataactaagaaatctaaagaacaaatggaacaagaatctattaattaatagcaggcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaaaatcaacacctgtcgcagccaaaatgacagcttctgatggaatatctttaacagtctccaataattcatcaaccaatgcttctattacaattggtttggatgcggaaaaagcttaccagcttattctagaaaagttgggaaatcaaattcttgatggaattgctgatactattgttgatagtacagtccaagatattttagacaaaatcacaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgactccaacaacgtattcattacgtgtaggcggtttagaaagcggtgtggtatgggttaatgccctttctaatggcaatgatattttaggaataacaaatacttctaatgtatcttttttggaagtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaaataaccaaaaaggcttgcacgacatagtatacaaatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacacttccttccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgatttagagaagaatcgccaattatctgatttcttaatagagatacttcgcatcatatgttccggagtttctttgtcctcctataacgaaaatcttctacaacagctttttgaactttttaagcaaaagagctgatcctccgtcagctcatatatatatttattatatatatatttatttagggatttgattttacgagagaga

SEQ ID NO: 180 - protein, 451 aa, Chlamydia trachomatis; identical to SEQ ID NO: 135

SEQ ID NO: 181 - protein, 351 aa, Chlamydia trachomatis; identical to SEQ ID NO: 136

SEQ ID NO: 182 - protein, 264 aa, Chlamydia trachomatis; identical to SEQ ID NO: 137

SEQ ID NO: 183 - protein, 102 aa, Chlamydia trachomatis; identical to SEQ ID NO: 13

SEQ ID NO: 184 - protein, 264 aa, Chlamydia trachomatis; identical to SEQ ID NO: 139

SEQ ID NO: 185 - protein, 247 aa, Chlamydia trachomatis; identical to SEQ ID NO: 140

SEQ ID NO: 186 - protein, 305 aa, Chlamydia trachomatis; identical to SEQ ID NO: 61

SEQ ID NO: 187 - protein, 330 aa, Chlamydia trachomatis; identical to SEQ ID NO: 8

SEQ ID NO: 188 - DNA, 7502 bp, Chlamydia trachomatis; identical to SEQ ID NO: 54

SEQ ID NO: 189 - protein, 451 aa, Chlamydia trachomatis; identical to SEQ ID NO: 55

SEQ ID NO: 190 - protein, 354 aa, Chlamydia trachomatis; identical to SEQ ID NO: 83

SEQ ID NO: 191 - protein, 264 aa, Chlamydia trachomatis; identical to SEQ ID NO: 57

SEQ ID NO: 192 - protein, 102 aa, Chlamydia trachomatis; identical to SEQ ID NO: 13

SEQ ID NO: 193 - protein, 264 aa, Chlamydia trachomatis; identical to SEQ ID NO: 59

SEQ ID NO: 194 - protein, 247 aa, Chlamydia trachomatis; identical to SEQ ID NO: 60

SEQ ID NO: 195 - protein, 305 aa, Chlamydia trachomatis; identical to SEQ ID NO: 61

SEQ ID NO: 196 - protein, 330 aa, Chlamydia trachomatis; identical to SEQ ID NO: 8

SEQ ID NO: 197 - DNA, 7510 bp, Chlamydia trachomatis
aatatgaatataattttaattatatcacaatattgtgggtgtttgtactagaggacttacctcttccccagaacaataagaacacacactttgtctcgatgagagacaggaaatacgcatgatttcctcatcttttaatcctatttgctttaaatgaatcaaagcgcttgcacgaagtactctgggagtaatttttattttcatagcactatggaactctgcaagcctaaaattatgcgcaacctgacttgttgttacaggaatccctattttagaaacaaatactctcccatttctcccacaagtgtatttttgcaactcttccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaatctacttttatggaaagccatcgagcccattttcttaaccaaagctattcaaaatcggagctctaagattttaagaaattttttaacaaaagtccattatgaccaagtctaccaccctaccaccaagagttgcaaagtctaccaccaagagttgcaaagtctaccaccaagagttgcaaagtctaccaccaagagttgcaaatctctctcgtaaaatcaaatccctaaataaatatatatataataaatatatatatgagctgacggaggatcagctcttttgcttaaaaagttcaaaaagctgttgtagaagattttcgttataggaggacaaagaaactccggaacatatgatgcgaagtatctctattaagaaatcagataattggcgattcttctctgaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataatcgatccaaactctgactttcctcagaattcaaagttgctgagaatagttcaatggaaggaagtgtcttcttaaaatctagagaagcggcagtttgattttttttaaaaaagacatccgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaaacaattaatttgtctcctgcaacaaaagcttctttcgttaaccctcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatgtgtatactatgtcgtgcaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttgtctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcacttttcttttattttgcataacaaaccccgtaattcgaactgttttctctaaatataaaacctataagaaaaatccaataaaaattgtttaagcgtttgtttgaggtattacttccaaaaaagatacattagaagtatttgttattcctaaaatatcattgccattagaaagggcattaacccataccacaccgctttctaaaccgcctacacgtaatgaatacgttgttggagtcaatcctgtattagtaatgctggttcttagactacataaattaggaacgcctgatgagtatccataactaatcgcgcagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgctactgggagtgaataacccgttgcattgaattttattagtgattggaaagttgttaaaagctttcaacaaacctagagaagggtctgttttgattttgtctaaaatatcttggactgtattatcaacaatagtatcagcaattccatcaagaatttgatctcccaacttttctagaataagctggtaagctttttccgcatccaaaccaattgtaatagaagcattggttgatgaattattggagactgttaaagatattccatcagaagctgtcattttggctgcgacaggtgttgatgttgtcccaaggattatttgctggtccttgagcggctctgtcatttgcccaactttgatattatcagcaaagacgcagttttcagtgttatacaaataaaaaccagaatttcccattttaaaactcttttttattttgagctttaaataaattaggtttttagtttcaagcttgctattaattaatagattcttgttctaattgttccatttgttctttagatttcttagttatttcttcaaagcgctctttatttagatatagaatttcttttttagagagtttagaagaatccagaaattcaatacgttttcttctagataaccagccaagctgaatggcgatttctatacatttatcgatagctaactcgatttttttccagttccttgtacagatgtaccgattcatccttaaaatatatgcaagacttttaacgttaacgtttaataacaagttttctggccaagaattatccttagttaattttcgtctctttttcgcagctgctgtaatcacccagtcgataaatgtgtaagcatactttgatgcatttgggaaacgcatttttatttcttggtatacatttgcaggcttgattacaaagtaggattctatttgatctaccaagataggacatggctctacaacgaaccctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtataaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaataaccccttttgtgttccccttgtaattcgttgcggtcagtaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaactggatctgattcgcgattaaattaagcttatactgactatcactgcagatataaaaatgtgattctctaactgtttctccagcttcttctactcggaataattcttctttagagagatcccctctttgtaatttttcaccagatattcctgttaaattagcaataatccgctcaacaatttgacctgcgctcatttctagagataggaaaccaactctacgctgttgagtaaccgcaagatttatcgccatgtctatagctaaagctgttttccctatagatggcctagctgctataatcacgaaattacctttagctaagataactcctttatcatcaatatccttgtatcctgttgggaagccatcaaagaaagaattttgattctcagagaacgctgctcgtcttttttttatacgagccagcactccaatttctgactgtgagaatatatcataaatagaccggcctctagcgctgcgaatagaaaaagtctttgctatagcactatcaagccttccctttatacgctcaagcaatagaaacggagatctacgcaatggattttcattgtactcattaaacgagcggaaaatgaaattgctcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgggaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttgcggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtctttggatatgaatctgcaagagttttcccttttaaatcataatctaatcctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacggatgcgatgaacagtttgcaaacagcatccttcctaaaagagctaaaaaaaatcaacgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacgggacacgcaaccgcaaagatgatatttgcgtacgataaatcctctcgagaagacaatgcttcaaagaagatggctctaatatagcctaaaggtgttttttctggcaacag

SEQ ID NO: 198 - protein, 451 aa, Chlamydia trachomatis; identical to SEQ ID NO: 55

SEQ ID NO: 199 - protein, 354 aa, Chlamydia trachomatis; identical to SEQ ID NO: 83

SEQ ID NO: 200 - protein, 264 aa, Chlamydia trachomatis; identical to SEQ ID NO: 57

SEQ ID NO: 201 - protein, 102 aa, Chlamydia trachomatis; identical to SEQ ID NO: 13

SEQ ID NO: 202 - protein, 243 aa, Chlamydia trachomatis
MGCNLAQFLGKKVLLADLDPQSNLSSGLGASVRSNQKGLHDIVYTSNDLKSIICETKKDSVDLIPASFLSEQFRELDIHRGPSNNLKLFLNEYCAPFYDICIIDTPPSLGGLTKEAFVAGDKLIVCLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 203 - protein, 247 aa, Chlamydia trachomatis; identical to SEQ ID NO: 60

SEQ ID NO: 204 - protein, 305 aa, Chlamydia trachomatis; identical to SEQ ID NO: 61

SEQ ID NO: 205 - protein, 330 aa, Chlamydia trachomatis; identical to SEQ ID NO: 8

SEQ ID NO: 206 - DNA, 7480 bp, Chlamydia trachomatis
aatatgaatataattttaattatatcacaatattgtgggtgtttgtactagaggacttacctcttccccagaacaataagaacacacactttgtctcgatgagagacaggaaatacgcatgatttcctcatcttttaatcctatttgctttaaatgaatcaaagcgcttgcacgaagtactctgggagtaatttttattttcatagcactatggaactctgcaagcctaaaattatgcgcaacctgacttgttgttacaggaatccctattttagaaacaaatactctcccatttctcccacaagtgtatttttgcaactcttccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaatctacttttatggaaagccatcgagcccattttcttaaccaaagctattcaaaatcggagctctaagattttaagaaattttttaacaaaagtccattatgaccaagtctaccaccaagagttgcaaagtctaccaccaagagttgcaaagtctaccaccaagagttgcaaatctctctcgtaaaatcaaatccctaaataaatatatatataataaatatatatatgagctgacggaggatcagctcttttgcttaaaaagttcaaaaagctgttgtagaagattttcgttataggaggacaaagaaactccggaacatatgatgcgaagtatctctattaagaaatcagataattggcgattcttctctgaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataatcgatccaaactctgactttcctcagaattcaaagttgctgagaatagttcaatggaaggaagtgtcttcttaaaatctagagaagcggcagtttgattttttttaaaaaagacatccgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaaacaattaatttgtctcctgcaacaaaagcttctttcgttaaccctcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatgtgtatactatgtcgtgcaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttgtctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcacttttcttttattttgcataacaaaccccgtaattcgaactgttttctctaaatataaaacctataagaaaaatccaataaaaattgtttaagcgtttgtttgaggtattacttccaaaaaagatacattagaagtatttgttattcctaaaatatcattgccattagaaagggcattaacccataccacaccgctttctaaaccgcctacacgtaatgaatacgttgttggagtcaatcctgtattagtaatgctggttcttagactacataaattaggaacgcctgatgagtatccataactaatcgcgcagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgctactgggagtgaataacccgttgcattgaattttattagtgattggaaagttgttaaaagctttcaacaaacctagagaagggtctgttttgattttgtctaaaatatcttggactgtattatcaacaatagtatcagcaattccatcaagaatttgatctcccaacttttctagaataagctggtaagctttttccgcatccaaaccaattgtaatagaagcattggttgatgaattattggagactgttaaagatattccatcagaagctgtcattttggctgcgacaggtgttgatgttgtcccaaggattatttgctggtccttgagcggctctgtcatttgcccaactttgatattatcagcaaagacgcagttttcagtgttatacaaataaaaaccagaatttcccattttaaaactcttttttattttgagctttaaataaattaggtttttagtttcaagcttgctattaattaatagattcttgttctaattgttccatttgttctttagatttcttagttatttcttcaaagcgctctttatttagatatagaatttcttttttagagagtttagaagaatccagaaattcaatacgttttcttctagataaccagccaagctgaatggcgatttctatacatttatcgatagctaactcgatttttttccagttccttgtacagatgtaccgattcatccttaaaatatatgcaagacttttaacgttaacgtttaataacaagttttctggccaagaattatccttagttaattttcgtctctttttcgcagctgctgtaatcacccagtcgataaatgtgtaagcatactttgatgcatttgggaaacgcatttttatttcttggtatacatttgcaggcttgattacaaagtaggattctatttgatctaccaagataggacatggctctacaacgaaccctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtataaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaataaccccttttgtgttccccttgtaattcgttgcggtcagtaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaactggatctgattcgcgattaaattaagcttatactgactatcactgcagatataaaaatgtgattctctaactgtttctccagcttcttctactcggaataattcttctttagagagatcccctctttgtaatttttcaccagatattcctgttaaattagcaataatccgctcaacaatttgacctgcgctcatttctagagataggaaaccaactctacgctgttgagtaaccgcaagatttatcgccatgtctatagctaaagctgttttccctatagatggcctagctgctataatcacgaaattacctttagctaagataactcctttatcatcaatatccttgtatcctgttgggaagccatcaaagaaagaattttgattctcagagaacgctgctcgtcttttttttatacgagccagcactccaatttctgactgtgagaatatatcataaatagaccggcctctagcgctgcgaatagaaaaagtctttgctatagcactatcaagccttccctttatacgctcaagcaatagaaacggagatctacgcaatggattttcattgtactcattaaacgagcggaaaatgaaattgctcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgggaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttgcggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtctttggatatgaatctgcaagagttttcccttttaaatcataatctaatcctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacggatgcgatgaacagtttgcaaacagcatccttcctaaaagagctaaaaaaaatcaacgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacgggacacgcaaccgcaaagatgatatttgcgtacgataaatcctctcgagaagacaacgcttcaaagaagatggctctaatatagcctaaaggtgttttttctggcaacag

SEQ ID NO: 207 - protein, 451 aa, Chlamydia trachomatis; identical to SEQ ID NO: 55

SEQ ID NO: 208 - protein, 354 aa, Chlamydia trachomatis; identical to SEQ ID NO: 83

SEQ ID NO: 209 - protein, 264 aa, Chlamydia trachomatis; identical to SEQ ID NO: 57

SEQ ID NO: 210 - protein, 102 aa, Chlamydia trachomatis; identical to SEQ ID NO: 13

SEQ ID NO: 211 - protein, 264 aa, Chlamydia trachomatis; identical to SEQ ID NO: 59

SEQ ID NO: 212 - protein, 247 aa, Chlamydia trachomatis; identical to SEQ ID NO: 60

SEQ ID NO: 213 - protein, 309 aa, Chlamydia trachomatis
MVKKMGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTCGRNGRVFVSKIGIPVTTSQVAHNFRLAEFHSAMKIKITPRVLRASALIHLKQIGLKDEEIMRISCLSSRQSVCSYCSGEEVSPLVQTPTIL

SEQ ID NO: 214 - protein, 340 aa, Chlamydia trachomatis
MRIGYITRDFMGKGILSLQQEMSLEYSEKSYQEVLKIRQESYWKRMKSFSLFEVIMHWTASLNKHTCRSYRGSFLSLEKIGLLSLDMNLQEFSLLNHNLILDAIKKVSSAKTSWTEGTKQVRAASYISLTRFLNRMTQGIVAIAQPSKQENSRTFFKTREIVKTDAMNSLQTASFLKELKKINARDWLIAQTMLQGGKRSSEVLSLEISQICFQQATISFSQLKNRQTEKRIIITYPQKFMHFLQEYIGQRRGFVFVTRSGKMVGLRQIARTFSQAGLQAAIPFKITPHVLRATAVTEYKRLGCSDSDIMKVTGHATAKMIFAYDKSSREDNASKKMALI

SEQ ID NO: 215 - DNA, 7506 bp, Chlamydia trachomatis
tttgcaactcttggtggtagactttgcaactcttggtggtagactttgcaactcttggtggtagactttgcaactcttggtggtagacttggtcataatggacttttgttaaaaaatttcttaaaatcttagagctccgattttgaatagctttggttaagaaaatgggctcgatggctttccataaaagtagattgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaagagttgcaaaaatacacttatgggagaaatgggagagtatttgtttctaaaatagggattcctgtaacaacaagtcaggttgcgcataattttaggcttgcagagttccatagtgctatgaaaataaaaattactcccagagtacttcgtgcaagcgctttgattcatttaaagcaaataggattaaaagatgaggaaatcatgcgtatttcctgtctctcatcgagacaaagtgtgtgttcttattgttctggggaagaggtaagtcctctagtacaaacacccacaatattgtgatataattaaaattatattcatattctgttgccagaaaaaacacctttaggctatattagagccatcttctttgaagcgttgtcttctcgagaggatttatcgtacgcaaatatcatctttgcggttgcgtgtcccgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcgttgattttttttagctcttttaggaaggatgctgtttgcaaactgttcatcgcatccgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctaggattagattatgatttaaaagggaaaactcttgcagattcatatccaaagacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgcaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttcccatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagcaatttcattttccgctcgtttaatgagtacaatgaaaatccattgcgtagatctccgtttctattgcttgagcgtataaagggaaggcttgatagtgctatagcaaagactttttctattcgcagcgctagaggccggtctatttatgatatattctcacagtcagaaattggagtgctggctcgtataaaaaaaagacgagcagcgttctctgagaatcaaaattctttctttgatggcttcccaacgggatacaaggatattgatgataaaggagttatcttagctaaaggtaatttcgtgattatagcagctaggccatctatagggaaaacagctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccagttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattactgaccgcaacgaattacaaggggaacacaaaaggggttattttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgtttcccaaatgcatcaaagtatgcttacacatttatcgactgggtgattacagcagctgcgaaaaagagacgaaaattaactaaggataattcttggccagaaaacttgttattaaacgttaacgttaaaagtcttgcatatattttaaggatgaatcggtacatctgtacaaggaactggaaaaaaatcgagttagctatcgataaatgtatagaaatcgccattcagcttggctggttatctagaagaaaacgtattgaatttctggattcttctaaactctctaaaaaagaaattctatatctaaataaagagcgctttgaagaaataactaagaaatctaaagaacaaatggaacaattagaacaagaatctattaattaatagcaagcttgaaactaaaaacctaatttatttaaagctcaaaataaaaaagagttttaaaatgggaaattctggtttttatttgtataacactgaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataattcatcaaccaatgcttctattacaattggtttggatgcggaaaaagcttaccagcttattctagaaaagttgggagatcaaattcttgatggaattgctgatactattgttgataatacagtccaagatattttagacaaaatcaaaacagacccttctctaggtttgttgaaagcttttaacaactttccaatcactaataaaattcaatgcaacgggttattcactcccagtagcattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgactccaacaacgtattcattacgtgtaggcggtttagaaagcggtgtggtatgggttaatgccctttctaatggcaatgatattttaggaataacaaatacttctaatgtatcttttttggaagtaatacctcaaacaaacgcttaaacaatttttattggatttttcttataggttttatatttagagaaaacagttcgaattacggggtttgttatgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagacaacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttgcacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgtttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcggatgtcttttttaaaaaaaatcaaactgccgcttctctagattttaagaagacacttccttccattgaactattctcagcaactttgaattctgaggaaagtcagagtttggatcgattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatatgttccggagtttctttgtcctcctataacgaaaatcttctacaacagctttttgaactttttaagcaaaagagctgatcctccgtcagctcatatatatatttattatatatatatttatttagggatttgattttacgagagagagcac

SEQ ID NO: 216 - protein, 451 aa, Chlamydia trachomatis; identical to SEQ ID NO: 55

SEQ ID NO: 217 - protein, 354 aa, Chlamydia trachomatis; identical to SEQ ID NO: 83

SEQ ID NO: 218 - protein, 264 aa, Chlamydia trachomatis; identical to SEQ ID NO: 57

SEQ ID NO: 219 - protein, 102 aa, Chlamydia trachomatis; identical to SEQ ID NO: 13

SEQ ID NO: 220 - protein, 264 aa, Chlamydia trachomatis; identical to SEQ ID NO: 59

SEQ ID NO: 221 - protein, 247 aa, Chlamydia trachomatis; identical to SEQ ID NO: 60

SEQ ID NO: 222 - protein, 305 aa, Chlamydia trachomatis
MGSMAFHKSRLFLTFGDASEIWLSTLSHLTRKNYASGINFLVSLEILDLSETLIKAISLDHSESLFKIKSLDVFNGKVVSEASKQARAACYISFTKFLYRLTKGYIKPAIPLKDFGNTTFFKIRDKIKTESISKQEWTVFFEALRIVNYRDYLIGKLIVQGIRKLDEILSLRTDDLFFASNQISFRIKKRQNKETKILITFPISLMEELQKYTYGRNGRVFVSKIGIPVTTSQVAHNFRLAEFHSAMKIKITPRVLRASALIHLKQIGLKDEEIMRISCLSSRQSVCSYCSGEEVSPLVQTPTIL

SEQ ID NO: 223 - protein, 330 aa, Chlamydia trachomatis; identical to SEQ ID NO: 8

SEQ ID NO: 224 - DNA, 7493 bp, Chlamydia trachomatis
aatatgaatataattttaattatatcacaatattgtgggtgtttgtactagaggacttacctcttccccagaacaataagaacacacactttgtctcgatgagagacaggaaatacgcatgatttcctcatcttttaatcctatttgctttaaatgaatcaaagcgcttgcacgaagtactctgggagtaatttttattttcatagcactatggaactctgcaagcctaaaattatgcgcaacctgacttgttgttacaggaatccctattttagaaacaaatactctcccatttctcccacaagtgtatttttgcaactcttccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaatctacttttatggaaagccatcgagcccattttcttaaccaaagctattcaaaatcggagctctaagattttaagaaattttttaacaaaagtccattatgaccaagtctaccaccaagagttgcaaagtctaccaccaagagttgcaaagtctaccaccaagagttgcaaagtctaccaccaagagttgcaaatctctctcgtaaaatcaaatccctaaataaatatatatataataaatatatatatgagctgacggaggatcagctcttttgcttaaaaagttcaaaaagctgttgtagaagattttcgttataggaggacaaagaaactccggaacatatgatgcgaagtatctctattaagaaatcagataattggcgattcttctctaaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataatcgatccaaactctgactttcctcagaattcaaagttgctgagaatagttcaatggaaggaagtgtcttcttaaaatctagagaagcggcagtttgattttttttaaaaaagacatccgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaagcaattaatttgtctcctgcaacaaaagcttctttcgttaaccctcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatttgtatactatgtcgtgcaagcctttttggttatttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttgtctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcacttttcttttattttgcataacaaaccccgtaattcgaactgttttctctaaatataaaacctataagaaaaatccaataaaaattgtttaagcgtttgtttgaggtattacttccaaaaaagatacattagaagtatttgttattcctaaaatatcattgccattagaaagggcattaacccataccacaccgctttctaaaccgcctacacgtaatgaatacgttgttggtgtcaatcctgtattagtaatgctggttcttagactacataaattaggaacgcctgatgagtatccataactaatcgcgcagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgttactgggagtgaataacccgttgcattgaattttattagtgattggaaagttgttaaaagctttcaacaaacctagagaagggtctgttgtgattttgtctaaaatatcttggactgtactatcaacaatagtatcagcaattccatcaagaatttgatttcccaacttttctagaataagctggtaagctttttccgcatccaaaccaattgtaatagaagcattggttgatgaattattggagactgttaaagatattccatcagaagctgtcattttggctgcgacaggtgttgattttgtcccaaggattatttgctggtccttgagcggctctgtcatttgcccaactttgatattatcagcaaagacgcagttttcagtgttatacaaataaaaaccagaatttcccattttaaaactcttttttattttgagctttaaataaattaggtttttagtttcaagcctgctattaattaatagattcttgttccatttgttctttagatttcttagttatttcttcaaagcgctctttatttagatatagaatttcttttttagagagtttagaagaatccagaaattcaatgcgttttcttctagataaccagccaagctgaatggcgatttctatacatttatcgatagctaactcgatttttttccagttccttgtacagatgtaccgattcatccttaaaatatatgcaagacttttaacgttaacgtttaataacaagttttctggccaagaattatccttagttaattttcgtctctttttcgcagctgctgtaatcacccagtcgataaatgtgtaagcatactttgatgcgtttgggaaacgcatttttatttcttggtatacatttgcaggcttgattacaaagtaggattctatttgatctaccaagataggacatggctctacaacgaatcctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtacaaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaacaaccccttttgtgttccccttgtaattcgttgcggtcagtaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaaccggatctgattcgcgattaaattaagcttatactgactatcactgcagatataaaaatgtgattctctaactgtttctccagcttcttccactcggaataattcttctttagagagatcccctctttgtaatttttcaccagatattcctgttaaattagcaacaatccgctcaacaatttgacctgcgctcatttctagagataggaaaccaactctacgctgttgagtaaccgcaagatttatcgccatgtctatagctaaagctgttttccctatagatggcctagctgctataatcacgaaattacctttagctaagataactcctttatcatcaatatccttgtatcctgttgggaagccatcaaagaaagaattttgattctcagagaacgctgctcgtcttttttttatacgagccagcactccaatttctgactgtgagaatatatcataaatagaccggcctctagcgctgcgaatagaaaaagtctttgctatagcactatcaagccttccctttatacgctcaagcaatagaaacggagatctacgcaatggattttcattgtactcattaaacgagcggaaaatgaaattgctcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgggaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttgcggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtctttggatatgaatctgcaagagttttcccttttaaatcataatctaatcctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacggatgcgatgaacagtttgcaaacagcatccttcctaaaagagctaaaaaaaatcaacgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacgggacacgcaaccgcaaagatgatatttgcgtacgataaatcctctcgagaagacaacgcttcaaagaagatggctctaatatagcctaaaggtgttttttctggcaacag

SEQ ID NO: 225 - protein, 451 aa, Chlamydia trachomatis; identical to SEQ ID NO: 135

SEQ ID NO: 226 - protein, 351 aa, Chlamydia trachomatis; identical to SEQ ID NO: 136

SEQ ID NO: 227 - protein, 264 aa, Chlamydia trachomatis; identical to SEQ ID NO: 137

SEQ ID NO: 228 - protein, 102 aa, Chlamydia trachomatis; identical to SEQ ID NO: 13

SEQ ID NO: 229 - protein, 264 aa, Chlamydia trachomatis; identical to SEQ ID NO: 139

SEQ ID NO: 230 - protein, 247 aa, Chlamydia trachomatis; identical to SEQ ID NO: 140

SEQ ID NO: 231 - protein, 309 aa, Chlamydia trachomatis; identical to SEQ ID NO: 213

SEQ ID NO: 232 - protein, 340 aa, Chlamydia trachomatis; identical to SEQ ID NO: 214

SEQ ID NO: 233 - DNA, 7500 bp, Chlamydia trachomatis
tttgcaactcttggtggtagactttgcaactcttggtggtagactttgcaactcttggtggtagactttgcaactcttggtggtagacttggtcataatggacttttgttgaaaaatttcttaaaatcttagagctccgattttgaatagctttggttaagaaaatgggctcgatggctttccataaaagtaggttgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaataaaaattactcctagagtacttcgtgcaagcgctttgattcatttaaagcaaataggattaaaagatgaggaaatcatgcgtatttcctgtctttcatcgagacaaagtgtgtgttcttattgttctggggaagaggtaagtcctctagtacaaacacccccaatattgtgatataattaaaattatattcatattctgttgccagaaaaaacacttttaggctatattagagccatcttctttgaagcgttgtcttctcgagaagatttatcgtacgcaaatatcatctttgcggttgcgtgtcctgtgaccttcattatgtcggagtctgagcaccctaggcgtttgtactccgtcacagcggttgctcgaagcacgtgcggggttatcttaaaagggattgcagcttgtagtcctgcttgagagaacgtgcgggcgatttgccttaaccccaccatttttccggagcgagttacgaagacaaaacctcttcgttgaccgatgtactcttgtagaaagtgcataaacttctgaggataagttataataatcctcttttctgtctgacggttcttaagctgggagaaagaaatggtagcttgttggaaacaaatctgactaatctccaagcttaagacttcagaggagcgtttacctccttggagcattgtctgggcgatcaaccaatcccgggcattgattttttttagctcttttaggaaggacgctgtttgcaaactgttcatcgcatctgtttttactatttccctggttttaaaaaatgttcgactattttcttgtttagaaggttgcgctatagcgactattccttgagtcatcctgtttaggaatcttgttaaggaaatatagcttgctgctcgaacttgtttagtaccttcggtccaagaagtcttggcagaggaaacttttttaatcgcatctagaattagattatgatttaaaagggaaaactcttgcagattcatatccaaggacaatagaccaatcttttctaaagacaaaaaagatcctcgatatgatctacaagtatgtttgttgagtgatgcggtccaatgcataataacttcgaataaggagaagcttttcatgcgtttccaataggattcttggcgaatttttaaaacttcctgataagacttttcgctatattctaacgacatttcttgctgcaaagataaaatccctttacccatgaaatccctcgtgatataacctatccgtaaaatgtcctgattagtgaaataatcaggttgttaacaggatagcacgctcggtatttttttatataaacatgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgcttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagcttggttggttatctagaagaaaacgcattgaatttctggattcttctaaactctctaaaaaagaaattctatatctaaataaagagcgttttgaagaaataaccaagaaatctaaagaacaaatggaacaattagaacaagaatctattaattaatagcaaacttgaaactaaaaacctaatttatttaaagctcaaaataaaaaagagttttaaaatgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatagataacttactctaacgttggagttgatttgcacaccttagttttttgctcttttaagggaggaactggaaaaacaacactttctctaaacgtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctgatcctccgtcagctcatatatatatctattatatatatatatttagggatttgattttacgagagaga

SEQ ID NO: 234 - protein, 451 aa, Chlamydia trachomatis; identical to SEQ ID NO: 1

SEQ ID NO: 235 - protein, 354 aa, Chlamydia trachomatis; identical to SEQ ID NO: 2

SEQ ID NO: 236 - protein, 264 aa, Chlamydia trachomatis; identical to SEQ ID NO: 3

SEQ ID NO: 237 - protein, 102 aa, Chlamydia trachomatis; identical to SEQ ID NO: 4

SEQ ID NO: 238 - protein, 243 aa, Chlamydia trachomatis; identical to SEQ ID NO: 23

SEQ ID NO: 239 - protein, 247 aa, Chlamydia trachomatis; identical to SEQ ID NO: 6

SEQ ID NO: 240 - protein, 305 aa, Chlamydia trachomatis; identical to SEQ ID NO: 25

SEQ ID NO: 241 - protein, 330 aa, Chlamydia trachomatis; identical to SEQ ID NO: 8

SEQ ID NO: 242 - protein, 6 aa, Artificial Sequence
  source: /note="Description of Artificial Sequence: Synthetic 6xHis tag"
HHHHHH

SEQ ID NO: 243 - DNA, 60 bp, Artificial Sequence
  source: /note="Description of Artificial Sequence: Synthetic oligonucleotide"
ggggggggggaaaaacggccgattgtgatataattaaaattatattcatattctgttgcc

SEQ ID NO: 244 - DNA, 60 bp, Artificial Sequence
  source: /note="Description of Artificial Sequence: Synthetic oligonucleotide"
ggggggggggaaaaagtcgacattgggggtgtttgtactagaggacttacctcttcccca

SEQ ID NO: 245 - DNA, 24 bp, Artificial Sequence
  source: /note="Description of Artificial Sequence: Synthetic oligonucleotide"
aatagaccggcctctagcgctgcg

SEQ ID NO: 246 - DNA, 28 bp, Artificial Sequence
  source: /note="Description of Artificial Sequence: Synthetic oligonucleotide"
ccgcatccaaaccaattgtaatagaagc

SEQ ID NO: 247 - DNA, 26 bp, Artificial Sequence
  source: /note="Description of Artificial Sequence: Synthetic oligonucleotide"
aatgagtacaatgaaaatccattgcg

SEQ ID NO: 248 - DNA, 25 bp, Artificial Sequence
  source: /note="Description of Artificial Sequence: Synthetic oligonucleotide"
gaacaagaatctattaattaatagc

SEQ ID NO: 249 - DNA, 30 bp, Artificial Sequence
  source: /note="Description of Artificial Sequence: Synthetic oligonucleotide"
taccatggtgggaaaaatagacatggatcg

SEQ ID NO: 250 - DNA, 30 bp, Artificial Sequence
  source: /note="Description of Artificial Sequence: Synthetic oligonucleotide"
taccatggccatatctttgatacgacgccg

SEQ ID NO: 251 - DNA, 35 bp, Artificial Sequence
  source: /note="Description of Artificial Sequence: Synthetic oligonucleotide"
taccatggataactaagaaatctaaagaacaaatg

SEQ ID NO: 252 - DNA, 29 bp, Artificial Sequence
  source: /note="Description of Artificial Sequence: Synthetic oligonucleotide"
taccatggccattttgagccaatttggga

SEQ ID NO: 253 - DNA, 37 bp, Artificial Sequence
  source: /note="Description of Artificial Sequence: Synthetic oligonucleotide"
taccatggaataacaaatacttctaatgtatcttttt

SEQ ID NO: 254 - DNA, 38 bp, Artificial Sequence
  source: /note="Description of Artificial Sequence: Synthetic oligonucleotide"
taccatggtttaaaactcttttttattttgagctttaa

SEQ ID NO: 255 - DNA, 30 bp, Artificial Sequence
  source: /note="Description of Artificial Sequence: Synthetic oligonucleotide"
taccatggctaattctaggactgcttcaac

SEQ ID NO: 256 - DNA, 29 bp, Artificial Sequence
  source: /note="Description of Artificial Sequence: Synthetic oligonucleotide"
taccatggaacaaaccccgtaattcgaac

SEQ ID NO: 257 - DNA, 31 bp, Artificial Sequence
  source: /note="Description of Artificial Sequence: Synthetic oligonucleotide"
taccatggtctgtagctaatgtctatccaaa

SEQ ID NO: 258 - DNA, 32 bp, Artificial Sequence
  source: /note="Description of Artificial Sequence: Synthetic oligonucleotide"
taccatgggtttagagaaagtgttgtttttcc

SEQ ID NO: 259 - DNA, 33 bp, Artificial Sequence
  source: /note="Description of Artificial Sequence: Synthetic oligonucleotide"
taccatggtgaactttttaagcaaaagagctga

SEQ ID NO: 260 - DNA, 31 bp, Artificial Sequence
  source: /note="Description of Artificial Sequence: Synthetic oligonucleotide"
taccatgggctgagaatagttcaatggaagg

SEQ ID NO: 261 - DNA, 35 bp, Artificial Sequence
  source: /note="Description of Artificial Sequence: Synthetic oligonucleotide"
taccatggttcatttaaagcaaataggattaaaag

SEQ ID NO: 262 - DNA, 34 bp, Artificial Sequence
  source: /note="Description of Artificial Sequence: Synthetic oligonucleotide"
taccatggtttcttaaccaaagctattcaaaatc

SEQ ID NO: 263 - DNA, 32 bp, Artificial Sequence
  source: /note="Description of Artificial Sequence: Synthetic oligonucleotide"
taccatggaaaacttcctgataagacttttcg

SEQ ID NO: 264 - DNA, 30 bp, Artificial Sequence
  source: /note="Description of Artificial Sequence: Synthetic oligonucleotide"
taccatggagctaaaaaaaatcaatgcccg

SEQ ID NO: 265 - DNA, 25 bp, Artificial Sequence
  source: /note="Description of Artificial Sequence: Synthetic oligonucleotide"
atgaaaactcgttccgaaatagaaa

SEQ ID NO: 266 - DNA, 27 bp, Artificial Sequence
  source: /note="Description of Artificial Sequence: Synthetic oligonucleotide"
ttaccatacttttttaatagcggagaa

SEQ ID NO: 267 - DNA, 29 bp, Artificial Sequence
  source: /note="Description of Artificial Sequence: Synthetic oligonucleotide"
atggtaaattatagtaactgccacttcat

SEQ ID NO: 268 - DNA, 30 bp, Artificial Sequence
  source: /note="Description of Artificial Sequence: Synthetic oligonucleotide"
ttaattaatagattcttgttctaattgttc

SEQ ID NO: 269 - DNA, 27 bp, Artificial Sequence
  source: /note="Description of Artificial Sequence: Synthetic oligonucleotide"
atgggaaattctggtttttatttgtat

SEQ ID NO: 270 - DNA, 26 bp, Artificial Sequence
  source: /note="Description of Artificial Sequence: Synthetic oligonucleotide"
ttaagcgtttgtttgaggtattacct

SEQ ID NO: 271 - DNA, 25 bp, Artificial Sequence
  source: /note="Description of Artificial Sequence: Synthetic oligonucleotide"
atgcaaaataaaagcaaagtgaggg

SEQ ID NO: 272 - DNA, 25 bp, Artificial Sequence
  source: /note="Description of Artificial Sequence: Synthetic oligonucleotide"
ctattcagccttggaaaacatgtct

SEQ ID NO: 273 - DNA, 20 bp, Artificial Sequence
  source: /note="Description of Artificial Sequence: Synthetic oligonucleotide"
gtgggatgcaacttggccca

SEQ ID NO: 274 - DNA, 27 bp, Artificial Sequence
  source: /note="Description of Artificial Sequence: Synthetic oligonucleotide"
tcacgttgtcctctgagagtaatctcg

SEQ ID NO: 275 - DNA, 27 bp, Artificial Sequence
  source: /note="Description of Artificial Sequence: Synthetic oligonucleotide"
gtgaacaaactaaaaaaagaagcgaat

SEQ ID NO: 276 - DNA, 25 bp, Artificial Sequence
  source: /note="Description of Artificial Sequence: Synthetic oligonucleotide"
tcagctcttttgcttaaaaagttca

SEQ ID NO: 277 - DNA, 21 bp, Artificial Sequence
  source: /note="Description of Artificial Sequence: Synthetic oligonucleotide"
atgggctcgatggctttccat

SEQ ID NO: 278 - DNA, 23 bp, Artificial Sequence
  source: /note="Description of Artificial Sequence: Synthetic oligonucleotide"
tcaaagcgcttgcacgaagtact

SEQ ID NO: 279 - DNA, 25 bp, Artificial Sequence
  source: /note="Description of Artificial Sequence: Synthetic oligonucleotide"
atgggtaaagggattttatctttgc

SEQ ID NO: 280 - DNA, 27 bp, Artificial Sequence
  source: /note="Description of Artificial Sequence: Synthetic oligonucleotide"
ctatattagagccatcttctttgaagc

SEQ ID NO: 281 - DNA, 22 bp, Artificial Sequence
  source: /note="Description of Artificial Sequence: Synthetic oligonucleotide"
gatgctacagccccaactgatc

SEQ ID NO: 282 - DNA, 23 bp, Artificial Sequence
  source: /note="Description of Artificial Sequence: Synthetic oligonucleotide"
tgcactcccaactacagttttcc

SEQ ID NO: 283 - DNA, 27 bp, Artificial Sequence
  source: /note="Description of Artificial Sequence: Synthetic oligonucleotide"
agagccttcaccagcattttccgtggt

SEQ ID NO: 284 - DNA, 23 bp, Artificial Sequence
  source: /note="Description of Artificial Sequence: Synthetic oligonucleotide"
cctgacggacctttttcttcttc

SEQ ID NO: 285 - DNA, 24 bp, Artificial Sequence
  source: /note="Description of Artificial Sequence: Synthetic oligonucleotide"
atataaagtggacaaggcggactt

SEQ ID NO: 286 - DNA, 30 bp, Artificial Sequence
  source: /note="Description of Artificial Sequence: Synthetic oligonucleotide"
catagtctccgcccttgtaacgcacctcta

SEQ ID NO: 287 - DNA, 22 bp, Artificial Sequence
  source: /note="Description of Artificial Sequence: Synthetic oligonucleotide"
cattgcgcatccataagttttg

SEQ ID NO: 288 - DNA, 28 bp, Artificial Sequence
  source: /note="Description of Artificial Sequence: Synthetic oligonucleotide"
ggaggataacatgaagaaaccagtattt

SEQ ID NO: 289 - DNA, 30 bp, Artificial Sequence
  source: /note="Description of Artificial Sequence: Synthetic oligonucleotide"
ccccgttccttcttctgtacttatcccagg

SEQ ID NO: 290 - DNA, 29 bp, Artificial Sequence
  source: /note="Description of Artificial Sequence: Synthetic oligonucleotide"
taagaatggagagcctaaaataagtatgc

SEQ ID NO: 291 - DNA, 25 bp, Artificial Sequence
  source: /note="Description of Artificial Sequence: Synthetic oligonucleotide"
ccagcctctagtatctccagatcct

SEQ ID NO: 292 - DNA, 21 bp, Artificial Sequence
  source: /note="Description of Artificial Sequence: Synthetic oligonucleotide"
cagcgctatccggaggccacg

SEQ ID NO: 293 - DNA, 28 bp, Artificial Sequence
  source: /note="Description of Artificial Sequence: Synthetic oligonucleotide"
gcgttatgtgtttaacttgtagtttgct

SEQ ID NO: 294 - DNA, 25 bp, Artificial Sequence
  source: /note="Description of Artificial Sequence: Synthetic oligonucleotide"
tctatcagcgtcgtaagaaaagctt

SEQ ID NO: 295 - DNA, 30 bp, Artificial Sequence
  source: /note="Description of Artificial Sequence: Synthetic oligonucleotide"
cgcctcatcagcatattcagctcttccttt

SEQ ID NO: 296 - DNA, 24 bp, Artificial Sequence
  source: /note="Description of Artificial Sequence: Synthetic oligonucleotide"
aaatatttattggcggcagtttct

SEQ ID NO: 297 - DNA, 21 bp, Artificial Sequence
  source: /note="Description of Artificial Sequence: Synthetic oligonucleotide"
tttcggaagcagtgacaacct

SEQ ID NO: 298 - DNA, 25 bp, Artificial Sequence
  source: /note="Description of Artificial Sequence: Synthetic oligonucleotide"
ccgtaccaaccacgacaagtggcaa

SEQ ID NO: 299 - DNA, 23 bp, Artificial Sequence
  source: /note="Description of Artificial Sequence: Synthetic oligonucleotide"
cgtttttaccaagagccaattcc

SEQ ID NO: 300 - DNA, 23 bp, Artificial Sequence
  source: /note="Description of Artificial Sequence: Synthetic oligonucleotide"
cctttgtgttctgtgggagatgt

SEQ ID NO: 301 - DNA, 22 bp, Artificial Sequence
  source: /note="Description of Artificial Sequence: Synthetic oligonucleotide"
cggatggcccagcaaccgataa

SEQ ID NO: 302 - DNA, 24 bp, Artificial Sequence
  source: /note="Description of Artificial Sequence: Synthetic oligonucleotide"
tcaccaacttcggtcagtgttact

SEQ ID NO: 303 - DNA, 23 bp, Artificial Sequence
  source: /note="Description of Artificial Sequence: Synthetic oligonucleotide"
aggtttcccttttgctttacgtt

SEQ ID NO: 304 - DNA, 27 bp, Artificial Sequence
  source: /note="Description of Artificial Sequence: Synthetic oligonucleotide"
ccttcaggaagccgccatactttcaac

SEQ ID NO: 305 - DNA, 26 bp, Artificial Sequence
  source: /note="Description of Artificial Sequence: Synthetic oligonucleotide"
cagaaaatattggcttggataaagct

SEQ ID NO: 306 - DNA, 22 bp, Artificial Sequence
  source: /note="Description of Artificial Sequence: Synthetic oligonucleotide"
taggtacgtttgtgcgcattgt

SEQ ID NO: 307 - DNA, 25 bp, Artificial Sequence
  source: /note="Description of Artificial Sequence: Synthetic oligonucleotide"
tgaacgcggagtcatccctaccgat

SEQ ID NO: 308 - DNA, 23 bp, Artificial Sequence
  source: /note="Description of Artificial Sequence: Synthetic oligonucleotide"
ggacaatatgctcacgtttgctt

SEQ ID NO: 309 - DNA, 21 bp, Artificial Sequence
  source: /note="Description of Artificial Sequence: Synthetic oligonucleotide"
gaattacccctccgacgatct

SEQ ID NO: 310 - DNA, 28 bp, Artificial Sequence
  source: /note="Description of Artificial Sequence: Synthetic oligonucleotide"
cgtttccttttccaggttcatttggctc

SEQ ID NO: 311 - DNA, 11578 bp, Artificial Sequence
  source: /note="Description of Artificial Sequence: Synthetic polynucleotide"
tcctaggctaggtggagtgtctattatgcagatgtcataaaaaggagcgcagtactcattcagaaataactttaagttgttactaggtcctctatgaatatccaattctctaaactgttcggataaaaatgatgcaggaattaggtccacactatctttttttgtttcgcaaatgattgattttaaatcgtttgatgtgtatactatgtcgtgtaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttatctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaatcttttttcacatctttaacaattttaataaaatcgtccctcactttgcttttattttgcataacaaaccccgtaattcgaacttttttctctaaatataaaacctataagaaaaatccaataaaaattgtttaagcgtttgtttgaggtattacctccaaaaaagatacattagaagtatttgttattcctaaaatatcattgccattagaaagggcattaacccataccacaccgctttctaaaccgcctacacgtaatgaatacgttgtcggagtcaatcctgtattaataattctggttcttagactacataaattaggaacgcctgatgagtatccataactaatcgcgtagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgttcctgggagtgaataacccgttgcattgaattttattagtgattggaaagttgttaaaagctttcaacaaacctagagaagggtctgttgtgattttgtctaaaatatcttggactgtactatcaacaatagtatcagcaattccaccaagaatttgatctcccaacttttctagaataagctggtaagctttttccgcatccaaaccaattgtaatagaagcattggttgatggattattggagactgttaaagatattccatcagaagctgtcattttggctgcgacaggtgttgatgttgtcccaaggattatttgctggtccttgagcggctctgtcatttgcccaactttgatattatcagcaaagacgcagttttgagtgttatacaaataaaaaccagaatttcccattttaaaactcttttttattttgagctttaaataaattaggtttttagtttcaagtttgctattaattaatagattcttgttctaattgttccatttgttctttagatttcttagttatttcttcaaaacgctctttatttagatatagaatttcttttttagagagtttagaagaatccagaaattcaatgcgttttcttctagataaccaaccaagctgaatggcgatttctatacatttatcgatagctaactcgatttttttccagttccttgtacaaatgtaccgattcatccttaaaatatatgcaagacttttaacgttaacgtttaagaacaagttttctggccaagaattatccttagttaattttcgtctctttttcgcagctgctgtaatcacccagtcgataaatgtgtaagcatactttgatgcatttgggaagcgcatttttatttcttggtatacatttgcaggcttgattacaaagtaggattctatttgatctaccaagataggacatggctctacaacgaaccctttatgtttccgtgtagatggtgaattaaaaggtgttaagtctatatctatattttcttcgtcagttaaaccttcccatccttcgtaaatcctaatgatcggagaaagagtttggtaacggtctactatttgtgttccattagtccatcgagttctagttgccactattaaaaacggttgatgtcctaaatggtataaggcttctaaagcagtttcagcttcttttccactaaactcatacttatttctggatgttttataccgcttaactccataagcctctaagaattcagtttttgtaaaacggattcttggtatccatccttcaaattgaaaactatttgattctctggataaaacaaccccttttgtgttccccttgtaattcgttgcagtcagcaatctttggatagctgctaatgcatggtaatgagatgaaagaaaatcaagacctataacttctaccatcccattttgagccaatttgggagatatcttaatagattgaccaggtcttcttccaaacttctgattttcaaggtggataggacttttgatgaagtggcagttactataatttaccatacttttttaatagcggagaatttactaatttttggatcgaaatgtaataccgaagagaaaaccgatccatgtctatttttcccaacagttatctcacaattagaagacgattccttcctattgataaacaaaatcacatctgcgtcttgctctatttgaccgctgtctcgcaaatctgaaagcatgggaactttatttgctctatcctcaacttttctagatagttgggataaacaaactataggaatgtttagctctgaggctaaacctcttaaggttctagatatatctgctatttcattttgacgattttctccaaccgatgagttgatcaactgcaagtaatcgataaatattacgtctactcgatcttcttttctcagcaaccggatctgattcgcgattaaattaagcttatactgactatcactgcagatataaaaatgtgattctctaactgtttctccagcttcttctactcggaataattcttctttagagagatcccctctttgtaatttttcaccagatattcctgttaaattagcaataatccgctcaacaatttgacctgcgctcatttctagagataggaaaccaactctacgctgttgagtaaccgcaagatttatcgccatgtctatagctaaagcagttttccctatagatggcctagctgctataatcacgaaattacctttagctaagataactcctttatcatcaatatccttgtatcctgttgggaaggcatcaaagaaagaattttgattctcagagaacgttgctcgtcttttttttatacgagccagcactccaatttctgactgtgagaatatatcataaatagaccggcctctagcgctgcgaatagaaaaagtctttgctatagcactgtcaagccttccctttatacgctcaagcaatagaaacggagatctacgcaatggattttcattgtactcattaaacgagcggaaaatgaaattactcaaattttcttcagcgctacacacgctcaaatcatcgaggaaaaccgtatgagaaacggatctaagcttgtcatttgataaagcatcatgcaacattaacccgagatacgatttgtccatatctttgatacgacgccgcaaaagctcttcccaagccgagtctacagttataggtaatccattgtcttttaagtatttaaatactatgaatatgtttttatgatgagaacacttaaactcataattagcaagctgcctcagaatatactcagtagagtcttcaaatatcagagctttacctaacaacgcatactcgatatcttgcatgcgattttctatttcggaacgagttttcatgtttatataaaaaaataccgagcgtgctatcctgttaacaacctgattatttcactaatcaggacattttacggataggttatatcacgagggatttcatgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtccttggatatgaatctgcaagagttttcccttttaaatcataatctaattctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacagatgcgatgaacagtttgcaaacagcgtccttcctaaaagagctaaaaaaaatcaatgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacaggacacgcaaccgcaaagatgatatttgcgtacgataaatcttctcgagaagacaacgcttcaaagaagatggctctaatatagcctaaaagtgttttttctggcaacagaatatgaatataattttaattatatcacaatcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgacattgggggtgtttgtactagaggacttacctcttccccagaacaataagaacacacactttgtctcgatgaaagacaggaaatacgcatgatttcctcatcttttaatcctatttgctttaaatgaatcaaagcgcttgcacgaagtactctaggagtaatttttttttcatagcactatagaactctgcaagcctaaaattatgcgcaacctgacttgttgttacaggaatccctattttagaaacaaatactctcccatttctcccacaagtgtatttttgcaactcctccattaagctgataggaaatgtgattagaattttggtttctttattctgtctttttttaatgcgaaaggaaatctgattggatgcaaaaaatagatcgtctgtgcgcaaagacaaaatttcgtctaacttacggatcccttgtacaatcaatttaccgattaaatagtctctataattcactatccggagcgcttcaaaaaaaactgtccattcctgcttagaaatcgattctgttttgattttgtctcggattttaaaaaatgtagtgtttccaaaatctttcaatggaatagcgggtttaatatatcccttggtcaatctatacaaaaactttgtgaaagatatgtagcatgccgctctagcctgtttagaggcctctgaaacgacttttccattaaaaacatctagagacttgattttaaacaaagattcgctgtggtcaagagaaatagcctttatcaaggtttccgataaatccagaatctctaaagaaacaagaaagttaatcccagacgcataattttttctagttagatgagataaagtagataaccaaatttccgacgcgtccccaaaagttaagaacaacctacttttatggaaagccatcgagcccattttcttaaccaaagctattcaaaatcggagctctaagattttaagaaatttttcaacaaaagtccattatgaccaagtctaccaccaagagttgcaaagtctaccaccaagagttgcaaagtctaccaccaagagttgcaaagtctaccaccaagagttgcaaatctctctcgtaaaatcaaatccctaaatatatatatataatagatatatatatgagctgacggaggatcagctcttttgcttaaaaagttcaaaaagctgttgtagaagattttcgttataggaggacaaagaaactccggaacacatgatgcgaagtatctctattaagaaatcagataattggcgattcttctctgaatcagacttatctatcgtttctctaacgtctttgtttctagatgaaggaagaaattgatccaacacccttatcgccgatgagttcgacattccacatactttccctatcacatcgaccttggtttttaaatcgccttttctagcggccaaaatatatgcggatttataggggatcgattgaaactctttttgtagagtttggttggggaggtttataaaaagctcgtaatatgcaagagcattgtaagcagaagacttagttctaaaaactaactctatccaagatgaaaaagttgttgaggagaagtgatccttactcaggatttttctagcattatagattttttctcctaaaagaagtacgtgttgcttctgtatggattttatctgaccagtaagcagttttaccgctaggatgtcttcttgataaaattcttcatccgaatagttttgggactctgataaaaataattgatccaaactctgactttcctcagaattcaaagttgctgagaatagttcaatggaaggaagcgtcttcttaaaatctaaagaagcggcagtttgattttttttaaaaaagacattcgcttctttttttagtttgttcacgttgtcctctgagagtaatctcgttcatattcgatatgcaaaatatttgctatttcatgcgttaacttcagaatatcttctgcggccctagaatttggatagacattagctacagaatcttctttaagaagagaacggctgagagaaatatctcgacgaatttttgttgaaaaaagcttgtttttgtaaatagactcgataatgtctatatacatttggttagtcgagttacgatcatcccaaaaagacaaagctattccaagaatgtgttcttcttcaggttttccgaccgaacttaagaattcacgtatcttttgtaaccctagaatagaaaaaggttctggagttaaacaagcaattaatttgtctcctgcaacaaaagcttctttcgttaaccc

SEQ ID NO: 312 - DNA, 1356 bp, Artificial Sequence
  source: /note="Description of Artificial Sequence: Synthetic polynucleotide"
atgaaaactcgttccgaaatagaaaatcgcatgcaagatatcgagtatgcgttgttaggtaaagctctgatatttgaagactctactgagtatattctgaggcagcttgctaattatgagtttaagtgttctcatcataaaaacatattcatagtatttaaatacttaaaagacaatggattacctataactgtagactcggcttgggaagagcttttgcggcgtcgtatcaaagatatggacaaatcgtatctcgggttaatgttgcatgatgctttatcaaatgacaagcttagatccgtttctcatacggttttcctcgatgatttgagcgtgtgtagcgctgaagaaaatttgagtaatttcattttccgctcgtttaatgagtacaatgaaaatccattgcgtagatctccgtttctattgcttgagcgtataaagggaaggcttgacagtgctatagcaaagactttttctattcgcagcgctagaggccggtctatttatgatatattctcacagtcagaaattggagtgctggctcgtataaaaaaaagacgagcaacgttctctgagaatcaaaattctttctttgatgccttcccaacaggatacaaggatattgatgataaaggagttatcttagctaaaggtaatttcgtgattatagcagctaggccatctatagggaaaactgctttagctatagacatggcgataaatcttgcggttactcaacagcgtagagttggtttcctatctctagaaatgagcgcaggtcaaattgttgagcggattattgctaatttaacaggaatatctggtgaaaaattacaaagaggggatctctctaaagaagaattattccgagtagaagaagctggagaaacagttagagaatcacatttttatatctgcagtgatagtcagtataagcttaatttaatcgcgaatcagatccggttgctgagaaaagaagatcgagtagacgtaatatttatcgattacttgcagttgatcaactcatcggttggagaaaatcgtcaaaatgaaatagcagatatatctagaaccttaagaggtttagcctcagagctaaacattcctatagtttgtttatcccaactatctagaaaagttgaggatagagcaaataaagttcccatgctttcagatttgcgagacagcggtcaaatagagcaagacgcagatgtgattttgtttatcaataggaaggaatcgtcttctaattgtgagataactgttgggaaaaatagacatggatcggttttctcttcggtattacatttcgatccaaaaattagtaaattctccgctattaaaaaagtatggtaa

SEQ ID NO: 313 - DNA, 1065 bp, Artificial Sequence
  source: /note="Description of Artificial Sequence: Synthetic polynucleotide"
atggtaaattatagtaactgccacttcatcaaaagtcctatccaccttgaaaatcagaagtttggaagaagacctggtcaatctattaagatatctcccaaattggctcaaaatgggatggtagaagttataggtcttgattttctttcatctcattaccatgcattagcagctatccaaagattgctgactgcaacgaattacaaggggaacacaaaaggggttgttttatccagagaatcaaatagttttcaatttgaaggatggataccaagaatccgttttacaaaaactgaattcttagaggcttatggagttaagcggtataaaacatccagaaataagtatgagtttagtggaaaagaagctgaaactgctttagaagccttataccatttaggacatcaaccgtttttaatagtggcaactagaactcgatggactaatggaacacaaatagtagaccgttaccaaactctttctccgatcattaggatttacgaaggatgggaaggtttaactgacgaagaaaatatagatatagacttaacaccttttaattcaccatctacacggaaacataaagggttcgttgtagagccatgtcctatcttggtagatcaaatagaatcctactttgtaatcaagcctgcaaatgtataccaagaaataaaaatgcgcttcccaaatgcatcaaagtatgcttacacatttatcgactgggtgattacagcagctgcgaaaaagagacgaaaattaactaaggataattcttggccagaaaacttgttcttaaacgttaacgttaaaagtcttgcatatattttaaggatgaatcggtacatttgtacaaggaactggaaaaaaatcgagttagctatcgataaatgtatagaaatcgccattcagcttggttggttatctagaagaaaacgcattgaatttctggattcttctaaactctctaaaaaagaaattctatatctaaataaagagcgttttgaagaaataactaagaaatctaaagaacaaatggaacaattagaacaagaatctattaattaa

SEQ ID NO: 314 - DNA, 795 bp, Artificial Sequence
  source: /note="Description of Artificial Sequence: Synthetic polynucleotide"
atgggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaa

SEQ ID NO: 315 - DNA, 309 bp, Artificial Sequence
  source: /note="Description of Artificial Sequence: Synthetic polynucleotide"
atgcaaaataaaagcaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaatag

SEQ ID NO: 316 - DNA, 732 bp, Artificial Sequence
  source: /note="Description of Artificial Sequence: Synthetic polynucleotide"
gtgggatgcaacttggcccaatttttagggaaaaaagtgttacttgctgacctagacccgcaatccaatttatcttctggattgggggctagtgtcagaagtaaccaaaaaggcttacacgacatagtatacacatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacgtga

SEQ ID NO: 317 - DNA, 744 bp, Artificial Sequence
  source: /note="Description of Artificial Sequence: Synthetic polynucleotide"
gtgaacaaactaaaaaaagaagcgaatgtcttttttaaaaaaaatcaaactgccgcttctttagattttaagaagacgcttccttccattgaactattctcagcaactttgaattctgaggaaagtcagagtttggatcaattatttttatcagagtcccaaaactattcggatgaagaattttatcaagaagacatcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatgtcgaactcatcggcgataagggtgttggatcaatttcttccttcatctagaaacaaagacgttagagaaacgatagataagtctgattcagagaagaatcgccaattatctgatttcttaatagagatacttcgcatcatgtgttccggagtttctttgtcctcctataacgaaaatcttctacaacagctttttgaactttttaagcaaaagagctga

SEQ ID NO: 318 - DNA, 783 bp, Artificial Sequence
  source: /note="Description of Artificial Sequence: Synthetic polynucleotide"
atgggctcgatggctttccataaaagtaggttgttcttaacttttggggacgcgtcggaaatttggttatctactttatctcatctaactagaaaaaattatgcgtctgggattaactttcttgtttctttagagattctggatttatcggaaaccttgataaaggctatttctcttgaccacagcgaatctttgtttaaaatcaagtctctagatgtttttaatggaaaagtcgtttcagaggcctctaaacaggctagagcggcatgctacatatctttcacaaagtttttgtatagattgaccaagggatatattaaacccgctattccattgaaagattttggaaacactacattttttaaaatccgagacaaaatcaaaacagaatcgatttctaagcaggaatggacagttttttttgaagcgctccggatagtgaattatagagactatttaatcggtaaattgattgtacaagggatccgtaagttagacgaaattttgtctttgcgcacagacgatctattttttgcatccaatcagatttcctttcgcattaaaaaaagacagaataaagaaaccaaaattctaatcacatttcctatcagcttaatggaggagttgcaaaaatacacttgtgggagaaatgggagagtatttgtttctaaaatagggattcctgtaacaacaagtcaggttgcgcataattttaggcttgcagagttctatagtgctatgaaaaaaaaattactcctagagtacttcgtgcaagcgctttga

SEQ ID NO: 319 - DNA, 993 bp, Artificial Sequence
  source: /note="Description of Artificial Sequence: Synthetic polynucleotide"
atgggtaaagggattttatctttgcagcaagaaatgtcgttagaatatagcgaaaagtcttatcaggaagttttaaaaattcgccaagaatcctattggaaacgcatgaaaagcttctccttattcgaagttattatgcattggaccgcatcactcaacaaacatacttgtagatcatatcgaggatcttttttgtctttagaaaagattggtctattgtccttggatatgaatctgcaagagttttcccttttaaatcataatctaattctagatgcgattaaaaaagtttcctctgccaagacttcttggaccgaaggtactaaacaagttcgagcagcaagctatatttccttaacaagattcctaaacaggatgactcaaggaatagtcgctatagcgcaaccttctaaacaagaaaatagtcgaacattttttaaaaccagggaaatagtaaaaacagatgcgatgaacagtttgcaaacagcgtccttcctaaaagagctaaaaaaaatcaatgcccgggattggttgatcgcccagacaatgctccaaggaggtaaacgctcctctgaagtcttaagcttggagattagtcagatttgtttccaacaagctaccatttctttctcccagcttaagaaccgtcagacagaaaagaggattattataacttatcctcagaagtttatgcactttctacaagagtacatcggtcaacgaagaggttttgtcttcgtaactcgctccggaaaaatggtggggttaaggcaaatcgcccgcacgttctctcaagcaggactacaagctgcaatcccttttaagataaccccgcacgtgcttcgagcaaccgctgtgacggagtacaaacgcctagggtgctcagactccgacataatgaaggtcacaggacacgcaaccgcaaagatgatatttgcgtacgataaatcttctcgagaagacaacgcttcaaagaagatggctctaatatag

---

What is claimed is:

1. A nucleic acid vector that (i) comprises pgp1, pgp2, pgp4, pgp5, pgp6, pgp7 and pgp8 and (ii) comprises a deletion mutant of pgp3 or does not comprise pgp3.

2. The nucleic acid vector of claim 1, wherein pgpl encodes a polypeptide having the sequence SEQ ID NO: 1 or a sequence having at least 80% sequence identity thereto.

3. The nucleic acid vector of claim 1, wherein pgp2 encodes a polypeptide having the sequence SEQ ID NO: 2 or a sequence having at least 80% sequence identity thereto.

4. The isolated nucleic acid of claim 1, wherein pgp4 encodes a polypeptide having the sequence SEQ ID NO: 4 or a sequence having at least 80% sequence identity thereto.

5. The isolated nucleic acid of claim 1, wherein pgp5 encodes a polypeptide having the sequence SEQ ID NO: 5 or 14, or a sequence having at least 80% sequence identity thereto.

6. The isolated nucleic acid of claim 1, wherein pgp6 encodes a polypeptide having the sequence SEQ ID NO: 6 or a sequence having at least 80% sequence identity thereto.

7. The isolated nucleic acid of claim 1, wherein pgp7 encodes a polypeptide having the sequence SEQ ID NO: 7 or a sequence having at least 80% sequence identity thereto.

8. The isolated nucleic acid of claim 1, wherein pgp8 encodes a polypeptide having the sequence SEQ ID NO: 8 or a sequence having at least 80% sequence identity thereto.

9. The nucleic acid vector of claim 1, wherein the vector further comprises a gene encoding an antigen from *chlamydia* or non-*chlamydia* mucosal infectious pathogen.

10. The nucleic acid vector of claim 9, wherein the antigen is major outer membrane protein (MOMP) or fragments thereof, a polymorphic membrane proteins (PMP) or fragments thereof, or a High Temperature Requirement protein A (HtrA) or fragments thereof.

11. A pathogen lacking a naturally-occurring virulence plasmid and comprising the nucleic acid vector of claim 1, wherein the pathogen is *chlamydia*.

12. The pathogen of claim 11, wherein the *chlamydia* is a *Chlamydia trachomatis* (*C. trachomatis*) A, B, Ba, C, D, E, F, G, H, I, J, K, L1, L2, L3 serovariant.

13. The pathogen of claim 11, wherein the *chlamydia* comprises a chromosomal mutation that reduces the virulence of the *chlamydia* strain.

14. The pathogen of claim 13, wherein the chromosomal mutation is a mutation in the CT135 gene, a mutation in the CT166 gene, a mutation in the trp operon, a mutation in the trpA gene, or a mutation in the trpB gene, or a combination thereof.

15. A nucleic acid vector that (i) comprises pgp1, pgp2, pgp3, pgp5, pgp6, pgp7 and pgp8 and (ii) comprises a deletion mutant of pgp4 or does not comprise pgp4.

16. The nucleic acid vector of claim 15, wherein pgp1 encodes SEQ ID NO: 1 or a sequence having at least 80% sequence identity thereto, pgp2 encodes SEQ ID NO: 2 or a sequence having at least 80% sequence identity thereto, pgp3 encodes SEQ ID NO: 3 or a sequence having at least 80% sequence identity thereto, pgp5 encodes SEQ ID NOs: 5 or 14 or a sequence having at least 80% sequence identity thereto, pgp6 encodes SEQ ID NO: 6 or a sequence having at least 80% sequence identity thereto, pgp7 encodes SEQ ID NOs: 7 or 70 or a sequence having at least 80% sequence identity thereto, and pgp8 encodes SEQ ID NO 8 or a sequence having at least 80% sequence identity thereto.

17. The nucleic acid vector of claim 15, wherein the vector further comprises a gene encoding an antigen from *chlamydia* or non-*chlamydia* mucosal infectious pathogen.

18. The nucleic acid vector of claim 17, wherein the antigen is major outer membrane protein (MOMP) or fragments thereof, a polymorphic membrane proteins (PMP) or fragments thereof, or a High Temperature Requirement protein A (HtrA) or fragments thereof.

19. A pathogen lacking a naturally-occurring virulence plasmid and comprising the nucleic acid vector of claim 15, wherein the pathogen is *chlamydia*.

20. The pathogen of claim 19, wherein the *chlamydia* is a *Chlamydia trachomatis* (*C. trachomatis*) A, B, Ba, C, D, E, F, G, H, I, J, K, L1, L2, L3 serovariant.

21. The pathogen of claim 19, wherein the *chlamydia* comprises a chromosomal mutation that reduces the virulence of the *chlamydia* strain.

22. The pathogen of claim 19, wherein the chromosomal mutation is a mutation in the CT135 gene, a mutation in the CT166 gene, a mutation in the trp operon, a mutation in the trpA gene, or a mutation in the trpB gene, or a combination thereof.

23. A nucleic acid vector that (i) comprises pgp1, pgp2, pgp5, pgp6, pgp7 and pgp8, (ii) comprises a deletion mutant of pgp3 or does not comprise pgp3, and (iii) comprises a deletion mutant of pgp4 or does not comprise pgp4.

24. The nucleic acid vector of claim 23, wherein pgp1 encodes SEQ ID NO: 1 or a sequence having at least 80% sequence identity thereto, pgp2 encodes SEQ ID NO: 2 or a sequence having at least 80% sequence identity thereto, pgp5 encodes SEQ ID NOs: 5 or 14 or a sequence having at least 80% sequence identity thereto, pgp6 encodes SEQ ID NO: 6 or a sequence having at least 80% sequence identity thereto, pgp7 encodes SEQ ID NOs: 7 or 70 or a sequence having at least 80% sequence identity thereto, and pgp8 encodes SEQ ID NO: 8 or a sequence having at least 80% sequence identity thereto.

25. The nucleic acid vector of claim 24, wherein the vector further comprises a gene encoding an antigen from *chlamydia* or non-*chlamydia* infectious pathogen.

26. The nucleic acid vector of claim 25, wherein the antigen is major outer membrane protein (MOMP) or fragments thereof, a polymorphic membrane proteins (PMP) or fragments thereof, or a High Temperature Requirement protein A (HtrA) or fragments thereof.

27. A pathogen lacking a naturally-occurring virulence plasmid and comprising the nucleic acid vector of claim 23, wherein the pathogen is *chlamydia*.

28. The pathogen of claim 27, wherein the *chlamydia* is a *Chlamydia trachomatis* (*C. trachomatis*) A, B, Ba, C, D, E, F, G, H, I, J, K, L1, L2, L3 serovariant.

29. The pathogen of claim 27, wherein the *chlamydia* comprises a chromosomal mutation that reduces the virulence of the *chlamydia* strain.

30. The pathogen of claim 29, wherein the chromosomal mutation is a mutation in the CT135 gene, a mutation in the CT166 gene, a mutation in the trp operon, a mutation in the trpA gene, or a mutation in the trpB gene, or a combination thereof.

* * * * *